(12) United States Patent
Taunton et al.

(10) Patent No.: US 11,136,562 B2
(45) Date of Patent: Oct. 5, 2021

(54) CONDITIONALLY ACTIVE HETERODIMERIC POLYPEPTIDES AND METHODS OF USE THEREOF

(71) Applicant: The Regents of the University of California, Oakland, CA (US)

(72) Inventors: John W. Taunton, San Francisco, CA (US); Wendell A. Lim, San Francisco, CA (US); Chia-Yung Wu, San Francisco, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 0 days.

(21) Appl. No.: 15/629,235

(22) Filed: Jun. 21, 2017

(65) Prior Publication Data

US 2017/0306303 A1     Oct. 26, 2017

Related U.S. Application Data

(63) Continuation of application No. PCT/US2017/012634, filed on Jan. 6, 2017.

(60) Provisional application No. 62/276,725, filed on Jan. 8, 2016.

(51) Int. Cl.
| | | |
|---|---|---|
| *C12N 15/13* | (2006.01) | |
| *C12N 9/12* | (2006.01) | |
| *C07K 14/72* | (2006.01) | |
| *C07K 1/36* | (2006.01) | |
| *C07K 2/00* | (2006.01) | |
| *C07K 19/00* | (2006.01) | |
| *A61K 38/00* | (2006.01) | |

(52) U.S. Cl.
CPC ............... *C12N 9/12* (2013.01); *C07K 1/36* (2013.01); *C07K 2/00* (2013.01); *C07K 14/72* (2013.01); *C07K 19/00* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 5,359,046 A | 10/1994 | Capon et al. | |
| 5,712,149 A | 1/1998 | Roberts | |
| 5,830,462 A | 11/1998 | Crabtree et al. | |
| 5,834,266 A | 11/1998 | Crabtree et al. | |
| 5,869,337 A | 2/1999 | Crabtree et al. | |
| 5,871,753 A | 2/1999 | Crabtree et al. | |
| 5,906,936 A | 5/1999 | Eshhar et al. | |
| 5,912,172 A | 6/1999 | Eshhar et al. | |
| 6,133,456 A | 10/2000 | Holt et al. | |
| 6,150,527 A | 11/2000 | Holt et al. | |
| 6,165,787 A | 12/2000 | Crabtree et al. | |
| 6,410,319 B1 | 6/2002 | Raubitschek et al. | |
| 6,649,595 B2 | 11/2003 | Clackson et al. | |
| 7,404,950 B2 | 7/2008 | Spencer et al. | |
| 7,446,179 B2 | 11/2008 | Jensen et al. | |
| 7,446,190 B2 | 11/2008 | Sadelain et al. | |
| 7,741,465 B1 | 6/2010 | Eshhar et al. | |
| 8,106,191 B2 | 1/2012 | Holt et al. | |
| 8,399,645 B2 | 3/2013 | Campana et al. | |
| 8,492,122 B2 * | 7/2013 | Ostermeier | C12N 15/635 435/91.4 |
| 8,771,671 B2 | 7/2014 | Spencer et al. | |
| 8,911,993 B2 | 12/2014 | June et al. | |
| 8,999,949 B2 | 4/2015 | Spencer et al. | |
| 9,745,368 B2 | 8/2017 | Milone | |
| 9,856,322 B2 * | 1/2018 | Campana | C07K 16/2896 |
| 10,287,354 B2 | 5/2019 | Brogdon | |
| 2003/0003517 A1 * | 1/2003 | Klein | G01N 33/74 435/7.21 |
| 2003/0077249 A1 | 4/2003 | Bebbington et al. | |
| 2004/0038886 A1 | 2/2004 | Finney et al. | |
| 2005/0113564 A1 | 5/2005 | Campana et al. | |
| 2008/0057515 A1 | 3/2008 | Paszty et al. | |
| 2011/0286980 A1 | 11/2011 | Brenner | |
| 2012/0029063 A1 | 2/2012 | Zhang et al. | |
| 2012/0108455 A1 | 5/2012 | Kodandapani et al. | |
| 2012/0277286 A1 | 11/2012 | Youle et al. | |
| 2013/0040836 A1 | 2/2013 | Himmler et al. | |
| 2013/0095097 A1 | 4/2013 | Blankenship et al. | |
| 2013/0195800 A1 | 8/2013 | Roeth et al. | |
| 2014/0050708 A1 | 2/2014 | Powell et al. | |

(Continued)

FOREIGN PATENT DOCUMENTS

| | | |
|---|---|---|
| EP | 481673 | 4/1992 |
| FR | 2968013 | 6/2012 |

(Continued)

OTHER PUBLICATIONS

Camacho-Soto, et al.; "Ligand-Gated Split-Kinases"; Journal of the American Chemical Society; vol. 136, pp. 3995-4002 (2014).

(Continued)

*Primary Examiner* — Michael D Pak
(74) *Attorney, Agent, or Firm* — James S. Keddie; Bozicevic, Field & Francis LLP

(57) ABSTRACT

The present disclosure provides conditionally active, heterodimeric polypeptides. The conditionally active, heterodimeric polypeptides are active in the presence of a dimerizing agent that induces dimerization of the polypeptides of the heterodimer. A conditionally active, heterodimeric polypeptide of the present disclosure is useful in a variety of research and treatment methods, which are also provided.

18 Claims, 121 Drawing Sheets

Specification includes a Sequence Listing.

(56) References Cited

U.S. PATENT DOCUMENTS

| | | | |
|---|---|---|---|
| 2014/0099309 A1 | 4/2014 | Powell et al. | |
| 2014/0134142 A1 | 5/2014 | Smith et al. | |
| 2014/0286987 A1 | 9/2014 | Spencer et al. | |
| 2014/0308746 A1 | 10/2014 | Rossi et al. | |
| 2015/0368342 A1 | 12/2015 | Wu et al. | |
| 2017/0292118 A1* | 10/2017 | Duchateau | C07K 14/7051 |
| 2017/0306303 A1 | 10/2017 | Taunton et al. | |

FOREIGN PATENT DOCUMENTS

| | | |
|---|---|---|
| WO | WO 2001/032866 | 5/2001 |
| WO | WO 2002/070559 | 9/2002 |
| WO | WO 2011/119773 A1 | 9/2011 |
| WO | WO 2012/079000 | 6/2012 |
| WO | WO 2012/099973 A2 | 7/2012 |
| WO | WO 2014/039523 A1 | 3/2014 |
| WO | WO 2014/127261 | 8/2014 |
| WO | WO 2015/057852 | 4/2015 |
| WO | WO 2015/090229 | 6/2015 |
| WO | WO 2015/123527 A1 | 8/2015 |
| WO | WO 2015/142661 | 9/2015 |
| WO | WO 2015/150771 | 10/2015 |
| WO | WO 2016/055551 | 4/2016 |
| WO | WO 2017/120546 | 7/2017 |

OTHER PUBLICATIONS

Camacho-Soto, et al.; "Small Molecule Gated Split-Tyrosine Phosphatases and Orthogonal Split-Tyrosine Kinases"; Journal of the American Chemical Society; vol. 136, No. 49, 9 pages (2014).

Chelur, et al.; "Targeted cell killing by reconstituted caspases"; PNAS; vol. 105, No. 2, pp. 2283-2288 (Feb. 13, 2007).

Dasgupta, et al.; "Nuclear Receptor Coactivators: Master Regulators of Human Health and Disease"; Annu. Rev. Med.; vol. 65, pp. 279-292 (2014).

Heldin, et al.; "Dimerization of Cell Surface Receptors in Signal Transduction"; Cell; vol. 80, pp. 213-223 (Jan. 27, 1995).

Hultman, et al.; "The Ligand-Dependent Interaction of Mineralocorticoid Receptor with Coactivator and Corepressor Peptides Suggests Multiple Activation Mechanisms"; Molecular Endocrinology; vol. 19, No. 6, pp. 1460-1473 (Jun. 2005).

Kawahara, et al.; "Engineering cytokine receptors to control cellular functions"; Biochemical Engineering Journal; vol. 48, pp. 283-294 (2010).

Liu, et al.; "Construction of a fluorescein-responsive chimeric receptor with strict ligand dependency"; Biotechnol Bioeng. Dec. 1, 2008;101(5):975-84. doi: 10.1002/bit.21961.

Ogawa, et al.; "Construction of Unnatural Heterodimeric Receptors Based on IL-2 and IL-6 Receptor Subunits"; Biotechnol. Prog.; vol. 29, No. 6, pp. 1512-1518 (2013).

Olefsky, et al.; "Minireview Prologue: Nuclear Receptor Minireview Series"; J. Biol. Chem.; vol. 276, pp. 36863-36864 (2001).

Stashi, et al.; "Steroid Receptor Coactivators: Servants and Masters for Control of Systems Metabolism"; Trends Endocrinol. Metab.; vol. 25, No. 7, pp. 337-347 (Jul. 2014).

Stuhlmann-Laeisz, et al.; "Forced dimerization of gp130 leads to constitutive STAT3 activation, cytokine-independent growth, and blockade of differentiation of embryonic stem cells"; Mol Biol Cell. Jul. 2006;17(7):2986-95. Epub Apr. 19, 2006.

Tetel; "Nuclear receptor coactivators: Essential players in steroid hormone action in brain and behavior"; J. Neuroendocrinol; vol. 21, No. 4, pp. 229-237 (Mar. 2009).

Abate-Daga, et a.; "CAR models: next-generation CAR modifications for enhanced T-cell function"; Molecular Therapy-Oncolytics; vol. 3, 7 pages (2016).

Baitsch, et al.; "Extended Co-Expression of Inhibitory Receptors by Human CD8 T-Cells Depending on Differentiation, Antigen-Specificity and Anatomical Localization"; PLoS One; vol. 7, No. 2, 10 pages (Feb. 2012).

Barnea, et al.; "The genetic design of signaling cascades to record receptor activation"; PNAS; vol. 105, No. 1, pp. 64-69 (Jan. 8, 2008).

Cartellieri, et al.; "Chimeric Antigen Receptor-Engineered T Cells for Immunotherapy of Cancer"; J. Biomed. Biotechnol.; vol. 2010, 13 pages (2010).

Curran, et al.; "Chimeric Antigen Receptors for T cell Immunotherapy: Current Understanding and Future Direction"; J Gene Med.; vol. 14, No. 6, pp. 405-415 (Jun. 2012).

Davila, et al.; "How do CARs work?: Early insights from recent clinical studies targeting CD19"; Oncoimmunology; vol. 1, No. 9, pp. 1577-1583 (Dec. 1, 2012).

Derose, et al.; "Manipulating signaling at will: chemically-inducible dimerization (CID) techniques resolve problems in cell biology"; Pflugers Arch; vol. 465, No. 3, pp. 409-417 (Jan. 9, 2013).

Di Stasi, et al.; "Inducible apoptosis as a safety switch for adoptive cell therapy"; N Engl J Med; vol. 365, No. 18, pp. 1673-1683 (Nov. 3, 2011).

Dotti, et al.; "Design and development of therapies using chimeric antigen receptor-expressing T cells"; Immunological Reviews; vol. 257, pp. 107-126 (2014).

Duttagupta, et al.; "Costimulation Signals for Memory CD8+T Cells During Viral Infections"; Crit. Rev. Immunol.; vol. 29, No. 6, pp. 469-486 (2009).

Fegan, et al.; "Chemically controlled protein assembly: techniques and applications"; Chem Rev; vol. 110, No. 6, pp. 3315-3336 (Jun. 9, 2010).

Fridy, et al.; "A robust pipeline for rapid production of versatile nanobody repertoires"; Nat. Methods; vol. 11, No. 12, pp. 1253-1260 (Dec. 2014)—Supplemental Materials.

Fridy, et al.; "A robust pipeline for rapid production of versatile nanobody repertoires"; Nat. Methods; vol. 11, No. 12, pp. 1253-1260 (Dec. 2014).

Gizinski, et al.; "Costimulation and T cells as therapeutic targets"; Best Pract. Res. Clin. Rheumatol.; vol. 24, No. 4, pp. 463-477 (Aug. 2010).

Gooz; "ADAM-17: The Enzyme That Does It All"; Crit. Rev. Biochem. Mol. Biol.; vol. 45, No. 2, pp. 146-169, 146-169 (Apr. 2010).

Gordon, et al.; "Effects of S1 cleavage on the structure, surface export, and signaling activity of human Notch1 and Notch2"; PLoS One; vol. 4, No. 8, 12 pages (Aug. 2009).

Graef, et al.; "Proximity and orientation underlie signaling by the non-receptor tyrosine kinase ZAP70"; EMBO J; vol. 16, No. 18, pp. 5618-5628 (Sep. 15, 1997).

Isakov; "Immunoreceptor tyrosine-based activation motif (ITAM), a unique module linking antigen and Fc receptors to their signaling cascades"; J. Leukoc . Biol.; vol. 61, No. 1, pp. 6-16 (Jan. 1997).

James, et al.; "Biophysical mechanism of T-cell receptor triggering in a reconstituted system"; Nature; vol. 487, pp. 64-69 (Jul. 5, 2012).

Juillerat, et al.; "Design of chimeric antigen receptors with integrated controllable transient functions"; Scientific Reports; doi: 10.1038/srep18950; 7 pages (Jan. 11, 2016).

Kalos, et al.; "T Cells with Chimeric Antigen Receptors Have Potent Antitumor Effects and Can Establish Memory in Patients with Advanced Leukemia"; Sci Transl Med.; vol. 3, No. 95, 12 pages (Aug. 10, 2011).

Kimchi-Sarfaty, et al.; "A 'Silent' Polymorphism in the MDR1 Gene Changes Substrate Specificity"; Science; vol. 315, pp. 525-528 (Jan. 26, 2007).

Kloss, et al.; "Combinatorial antigen recognition with balanced signaling promotes selective tumor eradication by engineered T cells"; Nat Biotechnol; vol. 31, pp. 71-75 (Dec. 16, 2012).

Kopan, et al.; "The Canonical Notch Signaling Pathway: Unfolding the Activation Mechanism"; Cell; vol. 137, pp. 216-233 (Apr. 17, 2009).

Lecourtois, et al.; "Indirect evidence for Delta-dependent intracellular processing of notch in Drosophila embryos"; Curr. Biol.; vol. 8, No. 13, pp. 771-774 (Jun. 1998).

Matsuda, et al.; "Synthetic Signal Propagation Through Direct Cell-Cell Interaction"; Sci. Signal; vol. 5, No. 220, 9 pages (Apr. 17, 2012).

(56) References Cited

OTHER PUBLICATIONS

Maus, et al.; "Antibody-modified T cells: CARs take the front seat for hematologic malignancies"; Blood; vol. 123, No. 17, pp. 2625-2635 (Apr. 24, 2014).

Mumm, et al.; "A ligand-induced extracellular cleavage regulates gamma-secretase-like proteolytic activation of Notch1"; Mol. Cell; vol. 5, No. 2, pp. 197-206 (Feb. 2000).

Ngo, et al.; "Computational Complexity, Protein Structure Prediction, and the Levinthal Paradox"; The Protein Folding Problem and Tertiary Structure Prediction; pp. 433 and 492-495 (1994).

Odorizzi, et al.; "Inhibitory Receptors on Lymphocytes: Insights from Infections"; J. Immunol.; vol. 188, No. 7, pp. 2957-2965 (Apr. 1, 2012).

Porter, et al.; "Chimeric antigen receptor-modified T cells in chronic lymphoid leukemia"; Engl J Med; vol. 365, No. 8, pp. 725-733 (Aug. 25, 2011).

Rosenberg; "Raising the bar: the curative potential of human cancer immunotherapy"; Science Translational Medicine; vol. 4, Issue 127, pp. 127ps8 (Mar. 23, 2012).

Sadelain, et al.; "The promise and potential pitfalls of chimeric antigen receptors"; Current Opinion in Immunology; vol. 21, No. 2, pp. 215-223 (Apr. 1, 2009).

Sanchez-Irizarry, et al.; "Notch Subunit Heterodimerization and Prevention of Ligand-Independent Proteolytic Activation Depend, Respectively, on a Novel Domain and the LNR Repeats"; Molecular and Cellular Biology; vol. 24, No. 21, 9265-9273 (Nov. 2004).

Schreiber; "Chemical Genetics Resulting from a Passion for Synthetic Organic Chemistry"; Bioorganic & Medicinal Chemistry; vol. 6, pp. 1127-1152 (1998).

Song, et al.; "In vivo persistence, tumor localization and anti-tumor activity of CAR engineered T cells is enhanced by costimulatory signaling through CD137 (4-1BB)"; Cancer Res.; vol. 71, No. 13, pp. 4617-4627 (Jul. 1, 2011).

Struhl, et al.; "Nuclear access and action of notch in vivo"; Cell; vol. 93, No. 4, pp. 649-660 (May 15, 1998).

Tone, et al.; "Cell Fate Conversion by Conditionally Switching the Signal-Transducing Domain of Signalobodies"; Biotechnology and Bioengineering; vol. 110, No. 12, pp. 3219-3226 (Dec. 2013).

Voet, et al.; Biochemistry; pp. 126-128 (1990).

Vooijs, et al.; "Mapping the consequence of Notch1 proteolysis in vivo with NIP-CRE"; Development; vol. 132, No. 3, pp. 535-544 (Feb. 2007).

Weissman, et al.; "Molecular cloning and chromosomal localization of the human T-cell receptor zeta chain: distinction from the molecular CD3 complex"; PNAS; vol. 85, No. 24, pp. 9709-9713 (Dec. 1988).

Wu, et al.; "Remote control of therapeutic T cells through a small molecule-gated chimeric receptor"; Sciencexpress; sciencemag.org/content/early/recent; doi: 10.1126/science.aab4077; 15 pages (Sep. 24, 2015).

Zhao, et al.; "Multiple injections of electroporated autologous T cells expressing a chimeric antigen receptor mediate regression of human disseminated tumor"; Cancer Res.; vol. 70, No. 22, pp. 9053-9061 (Nov. 15, 2010).

Garfall, et al.; "Immunotherapy with Chimeric Antigen Receptors for Multiple Myeloma"; Discovery Medicine; vol. 17, No. 91, pp. 37-46 (Jan. 2014).

Tal, et al.; "An NCR1-based chimeric receptor endows T-cells with multiple anti-tumor specificities"; Oncotarget; vol. 5, No. 21, pp. 10949-10958 (Apr. 24, 2014).

Zhang, et al.; "LAT: The ZAP-70 Tyrosine Kinase Substrate that Links T Cell Receptor to Cellular Activation"; Cell; vol. 92, pp. 83-92 (Jan. 9, 1998).

Raulet; "Roles of the NKG2D Immunoreceptor and Its Ligands"; Nature Reviews Immunology; vol. 3, pp. 781-790 (Oct. 2003).

Gurevich, et al.; "Corepressors of agonist-bound nuclear receptors"; Toxicology and Applied Pharmacology; vol. 223, pp. 288-298 (2007).

Nagy, et al.; "Mechanism of the nuclear receptor molecular switch"; TRENDS in Biochemical Sciences; vol. 29, No. 6, pp. 317-324 (Jun. 2004).

Robyr, et al.; "Nuclear Hormone Receptor Coregulators in Action: Diversity for Shared Tasks"; Molecular Endocrinology; vol. 14, No. 3, pp. 329-347 (2000).

Sadelain, et al.; "The Basic Principles of Chimeric Antigen Receptor Design"; Cancer Discovery; vol. 3, No. 4, pp. 388-398 (Apr. 2013).

Chang et al., "Dissection of the LXXLL Nuclear Receptor-Coactivator Interaction Motif Using Combinatorial Peptide Libraries: Discovery of Peptide Antagonists of Estrogen Receptors α and β", Molecular and Cellular Biology, 1999, 19(12): 8226-8239.

Dietz et al., "Comparative Molecular Profiling of the PPARa/g Activator Aleglitazar: PPAR Selectivity, Activity and Interaction with Cofactors", ChemMedChem, 2012, 7: 1101-1111.

Zetche et al., "A Split Cas9 Architecture for Inducible Genome Editing and Transcription Modulation", Nature Biotechnology, 2015; 33(2): 139-142.

Arkin, "A wise consistency: engineering biology for conformity, reliability, predictability", Current Opinion in Chemical Biology, 2013, 17:1-9.

Cowley et al., "Estrogen Receptors α and β Form Heterodimers on DNA", The Journal of Biological Chemistry, 1997, 272(32): 19858-19862.

Fu, "Grand challenges in synthetic biology to be accomplished", Frontiers in Bioengineering and Biotechnology, 2013, vol. 1, Article 02, pp. 1-3.

Groner et al., "Role of steroid receptor and coregulator mutations in hormone-dependent cancers", The Journal of Clinical Investigation, 2017, 127(4): 1126-1135.

Kapp et al., "Control of protein signaling using a computationally designed GTPase/GEF orthogonal pair", PNAS, 2012, 109(14): 5277-5282.

Lim, "Designing Customized Cell Signaling Circuits", Nat Rev Mol Cell Biol., 2010, 11(6): 393-403.

Tamrazi et al., "Estrogen Receptor Dimerization: Ligand Binding Regulates Dimer Affinity and Dimer Dissociation Rate", Molecular Endocrinology, 2002, 16(12): 2706-2719.

Whitaker et al., "Metabolic Pathway Flux Enhancement by Synthetic Protein Scaffolding", Methods in Enzymology, 2011, 497:447-468.

* cited by examiner

FIG. 1A

Mineralocorticoid receptor (*Homo sapiens*)

```
  1 metkgyhslp egldmerrwg qvsqaverss lgptertden nymeivnvsc vsgaipnnst
 61 qgsskekqel lpclqqdnnr pgiltsdikt eleskelsat vaesmglymd svrdadysye
121 qqnqqgsmsp akiyqnveql vkfykgnghr pstlscvntp lrsfmsdsgs svnggvmrav
181 vkspimchek spsvcspinm tssvcspagi nsvssttasf gsfpvhspit qgtpltcspn
241 venrgsrshs pahasnvgsp lssplssmks sissppshcs vkspvsspnn vtlrssvssp
301 aninnsrcsv sspsntnnrs tlsspaastv gslcspvnna fsytasgtsa gsstlrdvvp
361 spdtqekgaq evpfpkteev esaisngvtg qinivqyikp epdgafsssc lggnskinsd
421 ssfsvplkqe stkhscsgts fkgnptvnpf pfmdgsyfsf mddkdyysls gilgppvpgf
481 dgncegsgfp vgikqepddg syypeasips saivgvnsgg qsfhyrigaq gtisisrsar
541 dqsfqhlssf ppvntlvesw kshgdlssrr sdgyypvleyi penvssstlr svstgssrps
601 kiclvcgdea sgchygvvtc gsckvffkra vegqhnylca grndciidki rrkncpacrl
661 qkclqagmnl garkskklgk ikgiheeqpq qqqppppppp pqspeegtty iapakepsvn
721 talvpqlsti sraltpspvm vieniepeiv yagydsskpd taenllstln rlagkqmiqv
781 vkwakvlpgf knlpledqit liqyswmcls sfalswrsyk htnsqflyfa pdlvfneekm
841 hqsamyelcq gmhqislqfv riqltfeeyt imkvlilist ipkdglksqa afeemrtnyi
901 kelrkmvtkc pnnsgqswqr fyqltklids mhdlvsdlle fcfytfresh alkvefpaml
961 veiisdqipk vesgnakply fhrk
```

FIG. 1B
Amino acids 686-984 of *Homo sapiens* mineralocorticoid receptor

```
686                                       eeqpq qqqpppppp pqspeegtty iapakepsvn
721 talvpqlsti sraltpspvm vieniepeiv yagydsskpd taenllstln rlagkqmiqv
781 vkwakvlpgf knlpledqit liqyswmcls sfalswrsyk htnsqflyfa pdlvfneekm
841 hqsamyelcq gmhqislqfv riqltfeeyt imkvlllst ipkdglksqa afeemrtnyi
901 kelrkmvtkc pnnsgqswqr fyqltklids mhdlvsdlle fcfytfresh alkvefpaml
961 veiisdqipk vesgnakply fhrk
```

FIG. 1C
Amino acids 737-984 of *Homo sapiens* mineralocorticoid receptor

```
737              spvm vieniepeiv yagydsskpd taenllstln rlagkqmiqv
781 vkwakvlpgf knlpledqit liqyswmcls sfalswrsyk htnsqflyfa pdlvfneekm
841 hqsamyelcq gmhqislqfv riqltfeeyt imkvlllst ipkdglksqa afeemrtnyi
901 kelrkmvtkc pnnsgqswqr fyqltklids mhdlvsdlle fcfytfresh alkvefpaml
961 veiisdqipk vesgnakply fhrk
```

FIG. 1D

Amino acids 686-984 of *Homo sapiens* mineralocorticoid receptor, with S810L substitution

```
686                                   eeqpq qqqpppppp pqspeegtty iapakepsvn
721 talvpqisti sraltpspvm vieniepeiv yagydsskpd taenllstln rlagkqmiqv
781 vkwakvlpgf knlpledqit liqyswmcll sfalswrsyk htnsqflyfa pdlvfneekm
841 hqsamyelcq gmhqislqfv rlqltfeeyt imkvllilst ipkdglksqa afeemrtnyi
901 kelrkmvtkc pnnsgqswqr fyqltkllds mhdlvsdlle fcfytfresh alkvefpaml
961 veiisdqipk vesgnakply fhrk
```

FIG. 1E

Amino acids 737-984 of *Homo sapiens* mineralocorticoid receptor, with S810L substitution

```
737                spvm vieniepeiv yagydsskpd taenllstln rlagkqmiqv
781 vkwakvlpgf knlpledqit liqyswmcll sfalswrsyk htnsqflyfa pdlvfneekm
841 hqsamyelcq gmhqislqfv rlqltfeeyt imkvllilst ipkdglksqa afeemrtnyi
901 kelrkmvtkc pnnsgqswqr fyqltkllds mhdlvsdlle fcfytfresh alkvefpaml
961 veiisdqipk vesgnakply fhrk
```

Multiple sequence alignment of ligand-binding domain of mineralocorticoid receptors of various species

FIG. 1F, cont'd

```
                       170        180        190        200        210        220        230        240
                        ....|....|....|....|....|....|....|....|....|....|....|....|....|....|....|....|
Feature  1                                                                                    ##
                                                                                              ## #
2AA6_A            180   ----------------------------------------QAAFEEMRTNYIKELRKMVTKCPNNSGQSWQRFYQLTKLLDSMHDLVSDLLEFCFYTFRES---  240
gi_115529242      886   ----------------------------------------QAAFEEMRANYIKELKKMVTKCPSNSGQSWQRFYQLTKLLDSMHDLVSDLLEFCFYTFRES---  946
2AA2_A            180   ----------------------------------------QAAFEEMRTNYIKELRKMVTKCPNNSGQSWQRFYQLTKLLDSMHDLVSDLLEFCFYTFRES---  240
2A3I_A            158   ----------------------------------------QAAFEEMRTNYIKELRKMVTKCPNNSGQSWQRFYQLTKLLDSMHDLVSDLLEFCFYTFRES---  218
2OAX_A            161   ----------------------------------------QAAFEEMRTNYIKELRKMVTKAPNNSGQSWQRFYQLTKLLDSMHDLVSDLLEFCFYTFRES---  221
1Y9R_A            160   ----------------------------------------QAAFEEMRTNYIKELRKMVTKAPNNSGQSWQRFYQLTKLLDSMHDLVSDLLEFCFYTFRES---  220
2ABI_A            161   ----------------------------------------QAAFEEMRVNYIKELRKMVTKVLLKSPHNSGQSWQRFYQLTKLLDSMHDLVSDLLEFCFYTFRES---  221
gi_2500914        517   ----------------------------------------QAAFEEMRVNYIKELRKVLRRSVGKAPTTLDRRGNRSSQLTKLLDAMHDLGGELLDFCFYTFRES---  577
gi_30315969       264   ----------------------------------------QAAFEEMRLNYIKELRKVTKPTLKSVGKATNNSGQTWQRFFQLTKLLDSMQDLVGDLLEFCFYTFRES---  324
gi_47217367       333   ppspphmrtvpkegiknQAAFEEMRLNYIKELRRSVGKATNNSGQTWQRFFQLTKLLDAMHDVSTLCLPRHAAPLGRPhd  412

250        260        270        280        290        300        310        320
                        ....|....|....|....|....|....|....|....|....|....|....|....|....|....|....|....|
Feature  1
2AA6_A            241   ---------------------------------------------------------------HALKVEFPAMLVEIISDQLPKVESGN  266
gi_115529242      947   ---------------------------------------------------------------QALKVEFPAMLVEIISDQLPKVESGN  972
2AA2_A            241   ---------------------------------------------------------------HALKVEFPAMLVEIISDQLPKVESGN  266
2A3I_A            219   ---------------------------------------------------------------HALKVEFPAMLVEIISDQLPKVESGN  244
2OAX_A            222   ---------------------------------------------------------------HALKVEFPAMLVEIISDQLPKVESGN  247
1Y9R_A            221   ---------------------------------------------------------------HALKVEFPAMLVEIISDQLPKVESGN  246
2ABI_A            222   ---------------------------------------------------------------HALKVEFPAMLVEIISDQLPKVESGN  247
gi_2500914        578   ---------------------------------------------------------------QALKVEFPAMLVEIISDQLPKVESGN  603
gi_30315969       325   ---------------------------------------------------------------QALKVEFPEMLVEIISDQIPKVESGN  350
gi_47217367       413   ttgfppsfgesphlhtqskkaagtpcetaskymceyksklvgnlldfcfytfresQVLKVEFPEMLVEIISDQIPKVESGL  492
```

FIG. 1F, cont'd

```
Feature 1                    .....*.....
2AA6_A          267 AKPLYFHRK 275
gi_115529242    973 AKPLYFHRK 981
2AA2_A          267 AKPLYFHRK 275
2A3I_A          245 AKPLYFHRK 253
2OAX_A          248 AKPLYFHRK 256
1Y9R_A          247 AKPLYFHRK 255
2ABI_A          248 AKPLYFHRK 256
gi_25000914     604 AKPLYFHRK 612
gi_30315969     351 THTLYFHKK 359
gi_47217367     493 THTIYFHKK 501
```

FIG. 2A

Androgen receptor (*Homo sapiens*)

```
  1 mevqlgigrv yprppsktyr gafqnlifqsv reviqnpgpr hpeaaasaapp gaslilqqq
 61 qqqqqqqqq qqqqqqqet sprqqqqqg edgspqahrr gptgylvlde eqqpsqpqsa
121 lechpergcv pepgaavaas kglpqqlpap pdeddsaaps tislilgptfp glsscsadik
181 dilseastmq ilqgqqeav segsssgrar easgaptssk dnylggtsti sdnakelcka
241 vsvsmgigve alehispgeq irgdcmyapi lgvppavrpt pcaplaeckg silddsagks
301 tedtaeyspf kggytkgieg eslgcsgsaa agssgtielp stislyksga ideaaayqsr
361 dyynfplala gppppppph phariklenp ldygsawaaa aaqcrygdla slhgagaagp
421 gsgspsaaas sswhtlftae egqlygpcgg gggggggggg ggeagavapy
481 gytrppqgla gqesdftapd vwypggmvsr vpypsptcvk semgpwmdsy sgpygdmrle
541 tardhvlpid yyfppqktcl icgdeasgch ygaltcgsck vffkraaegk qkyicasrnd
601 ctidkfrrkn cpscrlrkcy eagmtlgark lkklgniklq eegeasstts pteettqkit
661 vshiegyecq pifinvleai epgvvcaghd nnqpdsfaal lssinelger qlvhvvkwak
721 alpgfrnlhv ddqmaviqys wmglmvfamg wrsftnvnsr mlyfapdlvf neyrmhksrm
781 ysqcvrmrhl sqefgwlqit pqeficmkal lifsiipvdg lknqkfifdel rmnyikeldr
841 iiackrknpt scsrrfyqit kildsvqpia reihqftfdi likshmvsvd fpemmaeiis
901 vqvpkilsgk vkpiyfhtq
```

FIG. 2B

Amino acids 619-919 of *Homo sapiens* androgen receptor

```
619                          cy eagmtigark lkklgniklq eegeasstts pteettqklt
661 vshiegyecq pifInvleai epgvvcaaghd nnqpdsfaal lssIneIger qlvhvvkwak
721 alpgfrnlhv ddqmaviqys wmglmvfamg wrsftnvnsr mlyfapdivf neyrmhksrm
781 ysqcvrmrhl sqefgwlqit pqeficmkal lifsiipvdg lknqkffdel rmnyikeldr
841 iiackrknpt scsrrfyqit kildsvqpia reihqftfdl likshmvsvd fpemmaeiis
901 vqvpkilsgk vkpiyfhtq
```

FIG. 2C

Amino acids 690-919 of *Homo sapiens* androgen receptor

```
690                        d nnqpdsfaal lssIneIger qlvhvvkwak
721 alpgfrnlhv ddqmaviqys wmglmvfamg wrsftnvnsr mlyfapdivf neyrmhksrm
781 ysqcvrmrhl sqefgwlqit pqeficmkal lifsiipvdg lknqkffdel rmnyikeldr
841 iiackrknpt scsrrfyqit kildsvqpia reihqftfdl likshmvsvd fpemmaeiis
901 vqvpkilsgk vkpiyfhtq
```

FIG. 2D

Amino acids 619-919 of *Homo sapiens* androgen receptor, with T877A substitution

```
619                                      cy eagmtigark lkklgniklq eegeasstts pteettqklt
661 vshiegyecq pifinvleai epgvvcaghd nnqpdsfaal lssineiger qlvhvvkwak
721 alpgfrnlhv ddqmaviqys wmglmvfamg wrsftnvnsr mlyfapdlvf neyrmhksrm
781 ysqcvrmrhl sqefgwlqit pqeficmkal lifsiipvdg lknqkffdel rmnyikeldr
841 iiackrknpt scsrrfyqit kildsvqpia relhqfafdl likshmvsvd fpemmaeiis
901 vqvpkilsgk vkpiyfhtq
```

FIG. 2E

Amino acids 690-919 of *Homo sapiens* androgen receptor with T877A substitution

```
690                  d nnqpdsfaal lssineiger qlvhvvkwak
721 alpgfrnlhv ddqmaviqys wmglmvfamg wrsftnvnsr mlyfapdlvf neyrmhksrm
781 ysqcvrmrhl sqefgwlqit pqeficmkal lifsiipvdg lknqkffdel rmnyikeldr
841 iiackrknpt scsrrfyqit kildsvqpia relhqfafdl likshmvsvd fpemmaeiis
901 vqvpkilsgk vkpiyfhtq
```

FIG. 2F

Amino acids 619-919 of *Homo sapiens* androgen receptor, with F876L substitution

```
619                 cy eagmtigark lkklgniklq eegeasstts pteettqklt
661 vshiegyecq pifinvleai epgvvcaghd nnqpdsfaal lssineiger qlvhvvkwak
721 alpgfrnlhv ddqmaviqys wmglmvfamg wrsftnvnsr mlyfapdivf neyrmhksrm
781 ysqcvrmrhl sqefgwlqit pqeficmkal lifsiipvdg lknqkffdel rmnyikeldr
841 iiackrknpt scsrrfyqit kildsvqpia reihqltfdi likshmvsvd fpemmaeiis
901 vqvpkilsgk vkpiyfhtq
```

FIG. 2G

Amino acids 690-919 of *Homo sapiens* androgen receptor, with F876L substitution

```
690              d nnqpdsfaal lssineiger qlvhvvkwak
721 alpgfrnlhv ddqmaviqys wmglmvfamg wrsftnvnsr mlyfapdivf neyrmhksrm
781 ysqcvrmrhl sqefgwlqit pqeficmkal lifsiipvdg lknqkffdel rmnyikeldr
841 iiackrknpt scsrrfyqit kildsvqpia reihqltfdi likshmvsvd fpemmaeiis
901 vqvpkilsgk vkpiyfhtq
```

FIG. 2H

Amino acids 619-919 of *Homo sapiens* androgen receptor, with F876L/T877A double substitution

```
619                cy eagmtlgark ikklgnlkiq eegeasstts pteettqklt
661  vshiegyecq pifinvleai epgvvcaghd nnqpdsfaal lssIneIger qlvhvvkwak
721  aipgfrnlhv ddqmaviqys wmglmvfamg wrsftnvnsr mlyfapdlvf neyrmhksrm
781  ysqcvrmrhl sqefgwlqit pqeflcmkal lifsiipvdg lknqkffdel rmnyikeldr
841  iiackrknpt scsrrfyqlt klldsvqpia relhqlafdi likshmvsvd fpemmaeiis
901  vqvpkilsgk vkpiyfhtq
```

FIG. 2I

Amino acids 690-919 of *Homo sapiens* androgen receptor, with F876L/T877A double substitution

```
690                   d nnqpdsfaal lssIneIger qlvhvvkwak
721  aipgfrnlhv ddqmaviqys wmglmvfamg wrsftnvnsr mlyfapdlvf neyrmhksrm
781  ysqcvrmrhl sqefgwlqit pqeflcmkal lifsiipvdg lknqkffdel rmnyikeldr
841  iiackrknpt scsrrfyqlt klldsvqpia relhqlafdi likshmvsvd fpemmaeiis
901  vqvpkilsgk vkpiyfhtq
```

FIG. 3A

Progesterone receptor (*Homo sapiens*)

```
  1 mtelkakgpr aphvaggpps pevgspllcr paagpfpgsq tsdtlpevsa ipisldgilf
 61 prpcggqdps dektqdqgsl sdvegaysra eatrgaggss ssppekdsgl ldsvldtlla
121 psgpgsqps ppacevtssw cifgpelped ppaapatqrv lspimsrsgc kvgdssgtaa
181 ahkvlprgls parqillpas esphwsgapv kpspqaaave veeedgsese esagpllkgk
241 pralggaaag ggaaavppga aagvalvpk edsrfsaprv alveqdapma pgrsplattv
301 mdfihvpilp inhallaart rqlledesyd ggagaasafa pprsspcass tpvavgdfpd
361 cayppdaepk ddayplysdf qppalkikee eegaeasars prsylvagan paafpdfplg
421 ppplpprat psrpgeaavt aapasasvss asssgstlec ilykaegapp qqgpfapppc
481 kapgasgcll prdgipstsa saaaagaapa lypalgingl pqigyqaavl kegipqvypp
541 ylnylrpdse asqspqysfe sipqkiclic gdeasgchyg vltcgsckvf fkramegqhn
601 ylcagrndci vdkirrkncp acrlrkccqa gmvlggrkfk kfnkvrvvra ldavalpqpv
661 gvpnesqals qrftfspgqd iqlipplini lmsiepdviy aghdntkpdt sssltsinq
721 lgerqlisvv kwsksipgfr nihlddqiti iqyswmslmv fglgwrsykh vsgqmlyfap
781 dliinegrmk essfyslcit mwqipqefvk lqvsqeefic mkvillinti pleglrsqtq
841 feemrssyir elikaigirq kgvvsssqrf yqitklidni hdlvkqlhly clntfiqsra
901 lsvefpemms eviaaqlpki lagmvkplif hkk
```

FIG. 3B

Amino acids 678-933 of *Homo sapiens* progesterone receptor

```
678                         gqd iqlipplinl lmsiepdviy aghdntkpdt ssslitslnq
721  lgerqlisvv kwsksklpgfr nihiddqiti iqyswmslmv fglgwrsykh vsgqmlyfap
781  dliineqrmk essfyslcit mwqipqefvk lqvsqeeflc mkvillinti plegirsqtq
841  feemrssyir elikaigirq kgvvsssqrf yqltklidnl hdivkqihly clntfiqsra
901  lsvefpemms eviaaqlpki lagmvkplif hkk
```

FIG. 3C

Amino acids 686-933 of *Homo sapiens* progesterone receptor

```
686                     plinl lmsiepdviy aghdntkpdt ssslitslnq
721  lgerqlisvv kwsksklpgfr nihiddqiti iqyswmslmv fglgwrsykh vsgqmlyfap
781  dliineqrmk essfyslcit mwqipqefvk lqvsqeeflc mkvillinti plegirsqtq
841  feemrssyir elikaigirq kgvvsssqrf yqltklidnl hdivkqihly clntfiqsra
901  lsvefpemms eviaaqlpki lagmvkplif hkk
```

FIG. 3D

Multiple sequence alignment of ligand-binding domain of progesterone receptors of various species

```
                       10         20         30         40         50         60         70         80
              ....*....|....*....|....*....|....*....|....*....|....*....|....*....|....*....|
                                          #    # ##                     #                   #  ##
Feature 1
1SR7_A        12   PLINLLMSIEPDVIYAGHDNTKPDTSSSLLTSLNQLGERQLLSVVKWSKSLPGFRNLHIDDQITLIQYSWMSLMVFGLGW  91
gi 130893    539   PMISVLRGIEPEVVYAGYDNTKPETPSSLLTSLNHLCERQLLCVVKMSLLPGFRNLHIDDQITLIQYSWMSLMVFAMGW  618
gi 82216083  456   ELLQILQSIEPEVVYAGYDNTQPETPSALLSSLNQLCERQLVCVVKWSKSLPGFRNLHIDDQITLLQYSWMSLMVFALGW  535
gi 169146179 306   QMISILENIEPQVVYSGYDNTQPEVPHLLINSLNRLCERQLLWIVRWSKSLPGFRNLHINDQMTLIQYSWMGLMLFSLGW  385
1SQN_A        14   PLINLLMSIEPDVIYAGHDNTKPDTSSSLLTSLNQLGERQLLSVVKWSKSLPGFRNLHIDDQITLIQYSWMSLMVFGLGW  93
1E3K_A        11   PLINLLMSIEPDVIYAGHDNTKPDTSSSLLTSLNQLGERQLLSVVKWSKSLPGFRNLHIDDQITLIQYSWMSLMVFGLGW  90
1A28_A         9   PLINLLMSIEPDVIYAGHDNTKPDTSSSLLTSLNQLGERQLLSVVKWSKSLPGFRNLHIDDQITLIQYSWMSLMVFGLGW  88

90        100        110        120        130        140        150        160
              ....*....|....*....|....*....|....*....|....*....|....*....|....*....|....*....|
                #                                #     # ##                            #
Feature 1
1SR7_A        92   RSYKHVSGQMLYFAPDLILNEQRMKESSFYSLCLTMWQIPQEFVKLQVSQEEFLCMKVLLLLNTIPLEGLRSQTQFEEMR  171
gi 130893    619   RSYKHVSGQMLYFAPDLILNEQRMKESSFYSLCLSMWQLPQEFVRLQVSQEEFLCMKALLLLNTIPLEGLRSQSQFDEMR  698
gi 82216083  536   RSYQHVSGQMLYFAPDLILNEQRMKDSSFYTLCLSMWQLPQEFmKLQVTHEEFLCMKALLLLNTVPLEGLKSQTNFDEMR  615
gi 169146179 386   RTFQNVTPDYLYFAPDLVLSNDQLRRSPIYDLCLAMQFVPQEFaNLQVTKEEFLCMKALMLLNTVPLEGLKSQTQFEEMR  465
1SQN_A        94   RSYKHVSGQMLYFAPDLILNEQRMKESSFYSLCLTMWQIPQEFVKLQVSQEEFLCMKVLLLLNTIPLEGLRSQTQFEEMR  173
1E3K_A        91   RSYKHVSGQMLYFAPDLILNEQRMKESSFYSLCLTMWQIPQEFVKLQVSQEEFLCMKVLLLLNTIPLEGLRSQTQFEEMR  170
1A28_A        89   RSYKHVSGQMLYFAPDLILNEQRMKESSFYSLCLTMWQIPQEFVKLQVSQEEFLCMKVLLLLNTIPLEGLRSQTQFEEMR  168

170        180        190        200        210        220        230        240
              ....*....|....*....|....*....|....*....|....*....|....*....|....*....|....*....|
                                                                #               # ##              #
Feature 1
1SR7_A       172   SSYIRELIKAIGLRQKGVVSsSQRFYQLTKLLDNLHDLVKQLHLYCLNTFIQSRALSVEFPEMMSEVIAAQLPKILAGMV  251
gi 130893    699   TSYIRELVKAIGLRQKGVVAnSQRFYQLTKLMDSMHDLVKQLHLFCLNTFLQSRALSVEFPEMMSEVIAAQLPKILAGMV  778
gi 82216083  616   SNYIRELAKAISLRHKGVIAsSQRFYQLTKLMDSMHELVKQLHLYCLNTFLQSRVLSVEFPEMMSEVISAQLPKILAGMV  695
gi 169146179 466   QNYICELSKAIQLKEKGVVAsSQRFYHLTKLMDNMHEIVKKVNLYCLSTFIQADAMKVEFPEMMTEVIASQLPKVLAGMV  545
1SQN_A       174   SSYIRELIKAIGLRQKGVVSsSQRFYQLTKLLDNLHDLVKQLHLYCLNTFIQSRALSVEFPEMMSEVIAAQLPKILAGMV  253
1E3K_A       171   SSYIRELIKAIGLRQKGVVSsSQRFYQLTKLLDNLHDLVKQLHLYCLNTFIQSRALSVEFPEMMSEVIAAQLPKILAGMV  250
1A28_A       169   SSYIRELIKAIGLRQKGVVSsSQRFYQLTKLLDNLHDLVKQLHLYCLNTFIQSRALSVEFPEMMSEVIAAQLPKILAGMV  248
```

FIG. 3D, cont'd

```
Feature 1                     .....*...
1SR7_A          252 KPLLFHKK 259
gi 130893       779 KPLLFHKK 786
gi 82216083     696 KPLVFHKK 703
gi 169146179    546 KPLMFHHK 553
1SQN_A          254 KPLLFHKK 261
1E3K_A          251 KPLLFHKK 258
1A28_A          249 KPLLFHKK 256
```

FIG. 4A

Thyroid hormone receptor-β (*Homo sapiens*)

```
  1 mtpnsmteng itawdkpkhc pdrehdwklv gmseacihrk shserrstlk neqssphliq
 61 ttwtssifhl dhddvndqsv ssaqtfqtee kkckgyipsy ldkdelcvvc gdkatgyhyr
121 citcegckgf frrtiqknih psysckyegk cvidkvtrnq cqecrfkkci yvgmatdlvl
181 ddskrlakrk lieenrekrr reelqksigh kpeptdeewe liktvteahv atnaggshwk
241 qkrkflpedi gqapivnape ggkvdieafs hftkiitpai trvvdfakkl pmfcelpced
301 qiilkgccm eimslraavr ydpesetlti ngemavtrgq lknglgvvs daifdlgmsl
361 ssfnlddtev allqavlims sdrpglacve riekyqdsfl lafehyinyr khhvthfwpk
421 llmkvtdirm igachasrfl hmkvecptel fpplflevfe d
```

FIG. 4B

Amino acids 202-461 of *Homo sapiens* thyroid hormone receptor-β

```
202                       eelqksigh kpeptdeewe liktvteahv atnaggshwk
241 qkrkflpedi gqapivnape ggkvdieafs hftkiitpai trvvdfakkl pmfcelpced
301 qiilkgccm eimslraavr ydpesetlti ngemavtrgq lknglgvvs daifdlgmsl
361 ssfnlddtev allqavlims sdrpglacve riekyqdsfl lafehyinyr khhvthfwpk
421 llmkvtdirm igachasrfl hmkvecptel fpplflevfe d
```

FIG. 4C

Amino acids 216-461 of *Homo sapiens* thyroid hormone receptor-β

```
181 ddskrlakrk lieenrekrr reelqksigh kpeptdeewe liktvteahv atnaggshwk
241 qkrkflpedi gqapivnape ggkvdieafs hftkiitpai trvvdfakkl pmfcelpced
301 qiilkgccm eimslraavr ydpesetlti ngemavtrgq lknglgvvs daifdlgmsl
361 ssfnlddtev allqavlims sdrpglacve riekyqdsfl lafehyinyr khhvthfwpk
421 llmkvtdirm igachasrfl hmkvecptel fpplflevfe d
```

FIG. 4D
Multiple sequence alignment of ligand-binding domain of thyroid hormone receptor-β of various species

```
                         10         20         30         40         50         60         70         80
                ....|....|....|....|....|....|....|....|....|....|....|....|....|....|....|....|
Feature  1                                                                     *   *    *  ##  ##  #  #
1NAV_A       17 PEEWDLIHIATEAHRSTnaqgshwkqrrkf------------lpddigqspivsmPDGDKVDLEAFSEFTKIITPAITRVVD  86
1N46_A       13 DEEWELIKTVTEAHVATnaqgshwkqkrkf------------lpedigqapivnaPEGGKVDLEAFSHFTKIITPAITRVVD  82
1BSX_A       15 DEEWELIKTVTEAHVATnaqgshwkqkrkf------------lpedigqapivnaPEGGKVDLEAFSHFTKIITPAITRVVD  84
2PIN_A        8 DEEWELIKTVTEAHVATnaqgshwkqkrkf------------lpedigqapivnaPEGGKVDLEAFSHFTKIITPAITRVVD  77
3D57_A       22 DEEWELIKTVTEAHVATnaqgshwkqkrkf------------lpedigqapivnaPEGGKVDLEAFSHFTKIITPAITRVVD  91
gi 1514135831 79 TCPKKVNRYYLNGSPKPgmpvpeaprppvv------------qngvvreadssgaMDDDMVDQDIFSHLAEVITPAIIKVVE 248
gi 134319141 59 AEEWELIHVTEAHRSTnaqgshwkqkrkf-------------lpedigqspmasmPDGDKVDLEAFSEFTKIITPAITRVVD 228
gi 6175061  170 SEEWELIRIVTEAHRSTnaqgshwkqrrkf------------lpedigqspmasmPDGDKVDLEAFSEFTKIITPAITRVVD 239
gi 82274155 223 SDPSGLIPDPLLDSRATsstfpqiltcpilrpgfsrpadappdkiggqspvaptSDGDKVDLEAFSEFTKIITPAITRVVD 302
gi 115732680 186 DHEEALIRAILVAHKQTshmyrres-------------------ssgeesePDSKKQKLEDEKPLSEIMTPSIVKVVE 244
gi 586092   216 DEEWELIKTVTEAHVATnaqgshwkqkrkf------------lpedigqapivnaPEGGKVDLEAFSHFTKIITPAITRVVD 285
gi 215273960 141 QEEWEMIRVVTEAHMATnaqgnhwkqkrkflsavg-vkeakpedigsapivnaPEGNKVDIEAFSQFTKIITPAITRVVD 219

90        100        110        120        130        140        150        160
                ....|....|....|....|....|....|....|....|....|....|....|....|....|....|....|....|
Feature  1         *          *   #          *       ###   *   #  # #  *   #            *
1NAV_A       87 FAKKLPMFsELPCEDQILLKGCCMEIMSLRAAVRYDPESDTLTLSGEMaVKREQLKNGGLGVVSDAIFELGKSLSaFNL 166
1N46_A       83 FAKKLPMFcELPCEDQILLKGCCMEIMSLRAAVRYDPESETLTLNGEMaVTRGQLKNGGLGVVSDAIFDLGMSLSsFNL 162
1BSX_A       85 FAKKLPMFcELPCEDQILLKGCCMEIMSLRAAVRYDPESETLTLNGEMaVTRGQLKNGGLGVVSDAIFDLGMSLSsFNL 164
2PIN_A       78 FAKKLPMFcELPCEDQILLKGCCMEIMSLRAAVRYDPESETLTLNGEMaVTRGQLKNGGLGVVSDAIFRLGMSLSsFNL 157
3D57_A       92 FAKKLPMFcELPCEDQILLKGCCMEIMSLRAAVRYDPESETLTLNGEMaVTRGQLKNGGLGVVSDAIFRLGMSLSsFNL 171
gi 1514135831 249 FAKQIPGFtKLVPDDQVALLKNCCFEVMCLRAASRFDKQRRTIMFGGLtVTKEQVSQGGLGRLAEPLFEFAEGLSqLHL 328
gi 134319141 229 FAKKLPMFsELPCEDQILLKGCCMEIMSLRAAVRYDPESETLTLSGEMaVKREQLKNGGLGVVSDAIFDLGKSLSaFNL 308
gi 6175061  240 FAKKLPMFsELTCEDQILLKGCCMEIMSLRAAVRYDPDSETLTLSGEMaVKREQLKNGGLGVVSDAIFDLGRSLAaFNL 319
gi 82274155 303 FAKKLPMFsELPCEDQILLKGCCMEIMSLRAAMRYDPESETLTLSGEMaVKREQLKNGGLGVVSDAIFDLGKSLAqFNL 382
gi 115732680 245 FAKRIPGFtGLHHDDQILLLKTCCMEIMCLRVAQKFDPDSQKLILSNGLrVGKSDMDHGVLSELIEPIFDFAVSMSrLQL 324
gi 586092   286 FAKKLPMFcELPCEDQILLKGCCMEIMSLRAAVRYDPESETLTLNGEMaVTRGQLKNGGLGVVSDMHGVLSELIEPIFDFAVSMSrLQL 365
gi 215273960 220 FAKKLPMFcELPCEDQILLKGCCMEIMSLRAAVRYDPESETLTLNGEMaVTRGQLKNGGLGVVSLSSFNL 299
```

FIG. 4D, cont'd

```
                              170        180        190        200        210        220        230        240
                     ....|....*....|....*....|....*....|....*....|....*....|....*....|....*....|....*....|
Feature 1
1NAV_A           167 DDTEVALLQAVLLMSTDRs--------------------------GLLCVDKIEKSQEAYLLAFEHYVNhrKHNIPHFW 219
1N46_A           163 DDTEVALLQAVLLMSSDRp--------------------------GLACVERIEKYQDSFLLAFEHYINyrKHHVTHFW 215
1BSX_A           165 DDTEVALLQAVLLMSSDRp--------------------------GLACVERIEKYQDSFLLAFEHYINyrKHHVTHFW 217
2PIN_A           158 DDTEVALLQAVLLMSSDRp--------------------------GLACVERIEKYQDSFLLAFEHYINyrKHHVTHFW 210
3D57_A           172 DDTEVALLAALLVVADRP---------------------------GLACVERIEKYQDSFLLAFEHYINyrKHHVTHFW 224
gi_151413583     329 DDTEVALLQAVLLMSSDRt--------------------------GVQDQESIDRLQDIILTAYKNYITrqRPHQPVLW 380
gi_13431914      309 DDTEVALLQAVLLMSSDRt--------------------------GLICVDKIEKCQETYLLAFEHYINyrKHNIPHFW 361
gi_6175061       320 DDTEVALLQAVLLMSSDRt--------------------------GLICTDKIEKCQETYLLAFEHYINyrKHNIPHFW 372
gi_82274155      383 DDTEVALLQAVLLMSSGNrrgrprpspapgstssssssssdrsGLTCTDKIEKCQETYLLAFEHYINhrKHNIPHFW 462
gi_115732680     325 TETEMALLAAVLLIAGDRp--------------------------GLKEAKLVETLQDSLLTAFQHFINesRPKTPVHM 377
gi_586092        366 DDTEVALLQAVLLMSSDRp--------------------------GLACVERIEKYQDSFLLAFEHYINyrKHHVTHFW 418
gi_215273960     300 DDSEVALLQAVILLSSDRp--------------------------GLTSVERIERCQEEFLLAFEHYINyrKHKVAHFW 352

250        260        270        280
                     ....|....*....|....*....|....*....|....*....|
                                  #          #                #
Feature 1
1NAV_A           220 PKLLMKVTDLRMIGACHASRFLHMKVECPTELfPPLFLFLEV 259
1N46_A           216 PKLLMKVTDLRMIGACHASRFLHMKVECPTELfPPLFLFLEV 255
1BSX_A           218 PKLLMKVTDLRMIGACHASRFLHMKVECPTELfPPLFLFLEV 257
2PIN_A           211 PKLLMKVTDLRMIGACHASRFLHMKVECPTELfPPLFLFLEV 250
3D57_A           225 PKLLMKVTDLRMIGACHASRFLHMKVECPTELfPPLFLFLEV 264
gi_151413583     381 GKILMKVTDLRMIGRALSVAHAEQVKLVKMECTNDI-PPLFLEM 419
gi_13431914      362 PKLLMKVTDLRMIGACHASRFLHMKVECPTELfPPLFLFLEV 401
gi_6175061       373 PKLLMKVTDLRMIGACHASRFLHMKVECPTELfPPLFLFLEV 412
gi_82274155      463 PKLLMKVTDLRMIGACHASRFLHMKVECPNELfPPLFLFLEV 502
gi_115732680     378 AKILMKITDLRTISARHAERIMCIKLDRPNEI-PQIFLEM 416
gi_586092        419 PKLLMKVTDLRMIGACHASRFLHMKVECPTELfPPLFLFLEV 458
gi_215273960     353 PKLLMKVTDLRMIGACHASRFLHMKVECPTELfPPLFLFLEV 392
```

FIG. 5A

Estrogen hormone receptor-α (*Homo sapiens*)

```
  1 mtmtlhtkas gmailhqiqg neleplnrpq lkiplerplg evyldsskpa vynypegaay
 61 efnaaaaana qvygqtgipy ylenepsgyt gpgseaaafg snglggfppl nsvspspiml lhpppqlspf
121 lqphgqqvpy ylenepsgyt vreagppafy rpnsdnrrqg grerlastnd kgsmamesak
181 etrycavcnd yasgyhygvw scegckaffk rsiqghndym cpatnqctid knrrkscqac
241 rlrkcyevgm mkggirkdrr ggrmikhkrq rddgegrgev gsagdmraan lwsplmikr
301 skknslaisl tadqmvsail daeppilyse ydptrpfsea smmglltnla dreivhminw
361 akrvpgfvdl tlhdqvhile cawleilmig lvwrsmehpv klifapnlll drnggkcveg
421 mveifdmila tssrfrmmnl qgeefvclks iillnsgvyt flsstiksle ekdhihrvld
481 kitdtlihlm akagitlqqq hqrlaqllii lshirhmsnk gmehlysmkc knvvplydll
541 lemldahrlh aptsrggasv eetdqshlat agstsshslq kyyitgeaeg fpatv
```

FIG. 5B
Amino acids 305-533 of *Homo sapiens* estrogen hormone receptor-α

```
305       slaisl tadqmvsail daeppilyse ydptrpfsea smmglltnla drelvhminw
361 akrvpgfvdl tlhdqvhile cawleilmig lvwrsmehpv klifapnlll drnqgkcveg
421 mveifdmila tssrfrmmnl qgeefvclks iillnsgvyt flsstiksle ekdhihrvid
481 kitdtlihlm akagitlqqq hqrlaqllii lshirhmsnk gmehlysmkc knv
```

FIG. 5C
Amino acids 282-595 of *Homo sapiens* estrogen hormone receptor-α

```
282                              sagdmraan lwpsplmikr
301 skknslaisl tadqmvsail daeppilyse ydptrpfsea smmglltnla drelvhminw
361 akrvpgfvdl tlhdqvhile cawleilmig lvwrsmehpv klifapnlll drnqgkcveg
421 mveifdmila tssrfrmmnl qgeefvclks iillnsgvyt flsstiksle ekdhihrvid
481 kitdtlihlm akagitlqqq hqrlaqllii lshirhmsnk gmehlysmkc knvvplydil
541 lemidahrlh aptsrggasv eetdqshiat agstsshslq kyyitgeaeg fpatv
```

Fig. 5D
Amino acids 310-547 of *Homo sapiens* estrogen hormone receptor-α

```
310          l tadqmvsail daeppilyse ydptrpfsea smmglltnla drelvhminw
361 akrvpgfvdl tlhdqvhile cawleilmig lvwrsmehpv klifapnlll drnqgkcveg
421 mveifdmila tssrfrmmnl qgeefvclks iillnsgvyt flsstiksle ekdhihrvid
481 kitdtlihlm akagitlqqq hqrlaqllii lshirhmsnk gmehlysmkc knvvplydll
541 lemidah
```

FIG. 5E

Amino acids 305-533 of *Homo sapiens* estrogen hormone receptor-α, with D351Y substitution

```
305         slalsl tadqmvsall daeppilyse ydptrpfsea smmglitnla yrelvhminw
361 akrvpgfvdl tihdqvhlle cawleilmig lvwrsmehpv kllfapnlll drnqgkcveg
421 mveifdmlla tssrfrmmnl qgeefvciks iilinsgvyt flsstiksle ekdhihrvld
481 kitdtlihim akagltlqqq hqrlaqlili lshirhmsnk gmehlysmkc knv
```

FIG. 5F

Amino acids 282-595 of *Homo sapiens* estrogen hormone receptor-α, with D351Y substitution

```
282                        sagdmraan lwpsplmikr
301 skknslalsl tadqmvsall daeppilyse ydptrpfsea smmglitnla yrelvhminw
361 akrvpgfvdl tihdqvhlle cawleilmig lvwrsmehpv kllfapnlll drnqgkcveg
421 mveifdmlla tssrfrmmnl qgeefvciks iilinsgvyt flsstiksle ekdhihrvld
481 kitdtlihlm akagltlqqq hqrlaqlili lshirhmsnk gmehlysmkc knvvplydll
541 lemldahrih aptsrggasv eetdqshiat agstsshslq kyyitgeaeg fpatv
```

FIG. 5G

Amino acids 310-547 of *Homo sapiens* estrogen hormone receptor-α, with D351Y substitution

```
310       1 tadqmvsall daeppilyse ydptrpfsea smmglitnla yrelvhminw
361 akrvpgfvdl tihdqvhlle cawleilmig lvwrsmehpv kllfapnlll drnqgkcveg
421 mveifdmlla tssrfrmmnl qgeefvciks iilinsgvyt flsstiksle ekdhihrvld
481 kitdtlihim akagltlqqq hqrlaqlili lshirhmsnk gmehlysmkc knvvplydll
541 lemldah
```

Multiple sequence alignment of ligand-binding domain of estrogen receptor alpha of various species

FIG. 5H, CONT'D

```
                       170       180       190       200       210       220       230       240
                ....*....|....*....|....*....|....*....|....*....|....*....|....*....|....*....|
Feature 1                                                                        #  #
1XP9_A      148 LNSGVYtflsstlksLEEKDHIHRVLDKITDTLIHLMAKAgltlqQQHQRLAQLLLILSHIRHMSNKGMEHLysMKCKNV 227
1YY4_A      144 LNSSMYplvt-atqdADSSRKLAHLLNAVTDALVWVIAKSglssqQQSMRLANLLMLLSHVRHASNKGMEHLlnMKCKNV 222
gi 170178459 447 YTTAVSr-------LQDYRQVQRLQHEINEALAEACSSTf---gFSPGNIARLMMIVSQVRQLSSLGVDHlnrLRGAET 515
gi 82209527  424 LNSNMClgsseggedLQSRSKLLCLLDSVTDALVWAISKTglsfqQRSTRLAHLIMLLSHIRHVSNKGMDHLhcMKMKKM 503
gi 119597    448 LNSGVYtflsstlksLEEERDYIHRVLDKITDTLIHLMAKSglslqQQHRRLAQLLLILSHIRHMSNKGMEHLynMKCKNV 527
gi 6015120   446 LNSGVYtflsstlesLEDTDLIHIILDKIIDTLVHFMAKSglslqQQQRRLAQLLLILSHIRHMSNKGMEHLysMKCKNV 525
gi 146742358 386 VHGSLKg------LESDTQVRQLQDDLTDALMDVCSERh--aLGSRRPAKMLLLSHLRQVSARASSHLgaVRNGLK 454
gi 186659995 285 LNASMMvat---sekDGSRAKVQQLVEATTDTLVKCIARRslatpEQFRRLSHLLTILSHIRHISNKGIQHMysMKCKNL 361

250
                ....*....|....*
Feature 1
1XP9_A      228 VPLYDLLLEMLDAH 241
1YY4_A      223 VPVYDLLLEMLNAH 236
gi 170178459 516 VSVEGLLREIVDEP 529
gi 82209527  504 VPLYDLLEMLDAH 517
gi 119597    528 VPLYDLLLEMLDAH 541
gi 6015120   526 VPLYDLLLEMLDAH 539
gi 146742358 455 VPLYDILLDILTDQ 468
gi 186659995 362 VPFYDLLLEMLDAH 375
```

FIG. 6A

Estrogen receptor-β (*Homo sapiens*)

```
  1 mdiknspssl nspssyncsq silplehgsi yipssyvdsh heypamtfys pavmnysips
 61 nvtnleggpg rqttspnvlw ptpghlspiv vhrqlshlya epqkspwcea rslehtlpvn
121 retlkrkvsg nrcaspvtgp gskrdahfca vcsdyasgyh ygvwscegck affkrsiqgh
181 ndyicpatnq ctidknrrks cqacrlrkcy evgmvkcgsr rercgyrlvr rqrsadeqlh
241 cagkakrsgg haprvreill dalspeqlvl tileaepphv lisrpsapft easmmmsltk
301 ladkelvhmi swakkipgfv elslfdqvrl lescwmevlm mglmwrsidh pgklifapdl
361 vldrdegkcv egileifdml lattsrfrel klqhkeylcv kamillnssm yplvtatqda
421 dssrklahll navtdalvwv iaksgissqq qsmrlanllm lishvrhasn kgmehllnmk
481 cknvpvydl lleminahvl rgckssitgs ecspaedsks kegsqnpqsq
```

FIG. 6B

Amino acids 260-502 of *Homo sapiens* estrogen hormone receptor-β

```
260          1 dalspeqlvl tileaepphv lisrpsapft easmmmsltk
301 ladkelvhmi swakkipgfv elslfdqvrl lescwmevlm mglmwrsidh pgklifapdl
361 vldrdegkcv egileifdml lattsrfrel klqhkeylcv kamillnssm yplvtatqda
421 dssrklahll navtdalvwv iaksgissqq qsmrlanllm lishvrhasn kgmehllnmk
481 cknvpvydl lleminahvl rg
```

FIG. 6B, con'td

```
                       170       180       190       200       210       220       230       240
                ....*....|....*....|....*....|....*....|....*....|....*....|....*....|....*....|
Feature  1                                                                           #  #
1XP9_A      148 LNSGVYtflsstlksLEEKDHIHRVLDKITDTLIHLMAKAgltiqQQHQRLAQLLILSHIRHMSNKGMEHLysMKCKNV 227
1YY4_A      144 LNSSMYplvt-atqdADSSRKLAHLLNAVTDALVWVIAKSgissqQQSMRLANLLMLLSHVRHASNKGMEHLlnMKCKNV 222
gi|701178459 447 YTTAVSr------LQDYRQVQRLQHEINEALAEACSSTf---gFSPGNIARLMMIVSQVRQLSSLGVDHlnrLRGAET 515
gi|82209527 424 LNSNMClgsseggedlQSRSKLLCLLDSVTDALVWAISKTglsfqQRSTRLAHLLMLLSHIRHVSNKGMDHhcMKMKKM 503
gi|119597   448 LNSGVYtflsstlksLEERDYIHRVLDKITDTLIHLMAKSglslqQQHRRLAQLLILSHIRHMSNKGMEHLynMKCKNV 527
gi|6015120  446 LNSGVYtflsstlesLEDTDLIHIILDKIIDTLVHFMAKSglslqQQQRRLAQLLILSHIRHMSNKGMEHLysMKCKNV 525
gi|146742358 386 VHGSLKg------LESDTQVRQLQDDLTDALMDVCSERh---algSRRPAKMLLLSHLRQVSARASSHlgaVRNGLK 454
gi|186659995 285 LNASMMvat---sekDGSRAKVQQLVEATTDDTLVKCIARRslatpEQFRRLSHLLTILSHIRHISNKGIQHMysMKCKNL 361

250
                ....*....|......
Feature  1
1XP9_A      228 VPLYDLLLEMLDAH 241
1YY4_A      223 VPVYDLLLEMLNAH 236
gi|701178459 516 VSVEGLLREIVDEP 529
gi|82209527 504 VPLYDLLLEMLDAH 517
gi|119597   528 VPLYDLLLEMLDAH 541
gi|6015120  526 VPLYDLLLEMLDAH 539
gi|146742358 455 VPLYDILLDILTDQ 468
gi|186659995 362 VPFYDLLLEMLDAH 375
```

FIG. 6C

Multiple sequence alignment of ligand-binding domain of estrogen receptor beta of various species

```
                        10        20        30        40        50        60        70        80
                ....*....|....*....|....*....|....*....|....*....|....*....|....*....|....*....|
Feature 1                                                        #    #    #
1XP9_A            4  LTADQMVSALIDAEPPILYSEYdptr---------pfsEASMMGLLTNLADRELVHMINWAKRVPGFVDLTLHDQVHLLECA   76
1YY4_A            1  LSPEQLVLTLLEAEPPHVLISRpsa---------pftEASMMMSLTKLADKELVHMISWAKKIPGFVELSLFDQVRLLESC   72
gi_170178459    303  NPTVPLISHLVNIEPNPILTGYnpqc--------tptEGYLMALVTDLANREIEGLVDWAARLPGYGMLPMDDQVNLIRTV  375
gi_82209527     280  LSPEELISRIMEAEPPEIYLMKdmkk--------pftEANVMMSLTNLADKELVHMISWAKKIPGFVELSLFDQVHLLECC  352
gi_119597       304  LTAEQMVSALLEAEPPIVYSEYdpnr--------pfnEASMMTLLTNLADRELVHMINWAKRVPGFVDLTLHDQVHLLECA  376
gi_6015120      302  LTAEQLISALMEAEAPIVYSEHdstk--------plsEASMMTLLTNLADRELVHMINWAKRVPGFVDLTLHDQVHLLECA  374
gi_146742358    226  QRLKALIDALDVKEGEHRGEEnhptgqqagnwqeisNPELIESVSSLVDRELTGIICWGKKIPGYSKLSLNDQVLLMEST   305
gi_186659995    141  LSSEQFLTCLLNAEPPNMTCHHdvsr--------pftAERLMMLLTNLADRELVHMIGWAKKVPGFVQISLRDQVLLLESS  213

90       100       110       120       130       140       150       160
                ....*....|....*....|....*....|....*....|....*....|....*....|....*....|....*....|
Feature 1              #    #
1XP9_A           77  WLEILMIGLVWRSMEHPG-KLLFAPNLLLDRNQGKc------VEGMVEIFDMLLATSSRFRMMNLQGEEFVCLKSIIL   147
1YY4_A           73  WMEVLMMGLMWRSIDHPG-KLIFAPDLVLDRDEGKC------VEGILEIFDMLLATTSRFRELKLQHKEYLCVKAMIL   143
gi_170178459    376  WLDLLMLGLVWRSMEHRGeWLVFAPDLLMDRSLCR-------LSGMEYICTPMLEFARQFADLQVPQEVYVCLKALTL   446
gi_82209527     353  WLEVLMLGLMWRSVNHPG-KLIFSPDLCLSRDESSc------VQGLVEIFDMLLAATSRFRELKLQREEYVCLKAMIL   423
gi_119597       377  WLEILMIGLVWRSMEHPG-KLLFAPNLLLDRNQGKc------VEGMVEIFDMLLATAARFRMMNLQGEEFVCLKSIIL   447
gi_6015120      375  WLEILMLMVGLIWRSVEHPG-KLSFAPNLLLDRNQGRc----VEGLVEIFDMLVTTATRFRMMRLRGEEFICLKSIIL   445
gi_146742358    306  WLDLLILDLVWCSIRHKGeKLLLSGGVLVNRNTISnrrnnssgdDMEVLEMCDQILSIATKFYEFDLQRREYLCLKAITL 385
gi_186659995    214  WLEVLIMGLIWRSMSQPG-KLVFASNLILDRDDGEc------VEGIFEIFDILLNIVQHFRELQVWMDEYVCLKAIIL   284
```

FIG. 7A
Peroxisome proliferator-activated receptor-gamma (PPAR-γ) (*Homo sapiens*)

```
  1 mvdtempfwp tnfgissvdl svmedhshsf dikpfttvdf ssistphyed ipftrtdpvv
 61 adykydiklq eyqsaikvep asppyysekt qlynkpheep snsimaiecr vcgdkasgfh
121 ygvhacegck gffrrtirik liydrcdlnc rihkksrnkc qycrfqkcla vgmshnairf
181 grmpqaekek llaeissdid qinpesadir alakhlydsy iksfpltkak arailtgktt
241 dkspfviydm nslmmgedki kfkhitplqe qskevairif qgcqfrsvea vqeiteyaks
301 ipgfvnidln dqvtlikygv heiiytmlas lmnkdgvlis eggfmtref lksirkpfgd
361 fmepkfefav kfnalelddS diaifiavii lsgdrpglln vkpiediqdn llqalelqik
421 lnhpessqlf akliqkmtdl rqivtehvql lqvikktetd msihpliqei ykdly
```

FIG. 7B
Amino acids 174-475 of *Homo sapiens* PPAR-γ

```
174                                                              shnairf
181 grmpqaekek llaeissdid qinpesadir alakhlydsy iksfpltkak arailtgktt
241 dkspfviydm nslmmgedki kfkhitplqe qskevairif qgcqfrsvea vqeiteyaks
301 ipgfvnidln dqvtlikygv heiiytmlas lmnkdgvlis eggfmtref lksirkpfgd
361 fmepkfefav kfnalelddS diaifiavii lsgdrpglln vkpiediqdn llqalelqik
421 lnhpessqlf akliqkmtdl rqivtehvql lqvikktetd msihpliqei ykdly
```

FIG. 7C
Amino acids 207-475 of *Homo sapiens* PPAR-γ

```
181 grmpqaekek llaeissdid qinpesadir alakhlydsy iksfpltkak arailtgktt
241 dkspfviydm nslmmgedki kfkhitplqe qskevairif qgcqfrsvea vqeiteyaks
301 ipgfvnidln dqvtlikygv heiiytmlas lmnkdgvlis eggfmtref lksirkpfgd
361 fmepkfefav kfnalelddS diaifiavii lsgdrpglln vkpiediqdn llqalelqik
421 lnhpessqlf akliqkmtdl rqivtehvql lqvikktetd msihpliqei ykdly
```

FIG. 7D
LBD of human PPARγ
Amino acids 205-475 of *Homo sapiens* PPAR-γ

```
205                     esadlr alakhlydsy iksfpltkak arailtgktt
241 dkspfviydm nslmmgedki kfkhitplqe qskevairif qgcqfrsvea vqeiteyaks
301 ipgfvnldln dqvtlkygv heiiytmlas lmnkdgvlis egqgfmtref lkslrkpfgd
361 fmepkfefav kfnaleldds dlaifiavii lsgdrpglln vkpiediqdn llqaleiqlk
421 lnhpessqlf akllqkmtdl rqivtehvql lqvikktetd mslhpllqei ykdly
```

FIG. 7E

Multiple sequence alignment of ligand-binding domain of PPAR-γ of various species

```
                       10         20         30         40         50         60         70         80
              ....*....|....*....|....*....|....*....|....*....|....*....|....*....|....*....|
Feature 1
1FM6_D          4  ADLRALAKHLYDSYIKsfpltkaKARAILTGKttdkspfvlydmnslmmge--------------------------  54
2J14_A         17  ADLKAFSKHIYNAYLKnfnmtkkKARSILTGKashtapfvihdietlwqae--------------------------  67
gi 47825369   207  ADLRALAKHLYDSYIKsfpltkaKARAILTGKtttdkspfvlydmnslrmge-------------------------  257
gi 82240332   230  ADLRALARHLYEAYLKyfpltkaKARAILSGKtgdnapfvihdiksimegeqfincrqmpiqeqqas----------  297
gi 122049643  176  TKLVSPCDEMLTPDLKarllfasQVFKKNIGKdkptiykn------------------------------------  215
gi 585720     129  SDLDVLSQLIHSSYMNtftmtkkRARDILTGRnsispfvihdmdtlwqaeq-------------------------  179
gi 72164991   137  RIHSIYINMWMGQFISmpvgsraTRSKEPNGKtedhksm-------------------------------------  175
gi 115899356  219  VDSIAQQFNDIVCAMTqed--leKFWKRCSRPftahmpsgtyviegm-----------------------------  263
gi 16565492    95  SDLRSLARLVQEAYLRifplskaKAQAILAGKvqnnavvihdheslaqaedtilqksgygtihhgsigvniasvggggcg  174

90        100        110        120        130        140        150        160
              ....*....|....*....|....*....|....*....|....*....|....*....|....*....|....*....|
                                                                                    ##    ##    #
Feature 1
1FM6_D         55  ----------------------------------------dkikfkhitplgeqskevaIRIFQGCQFRSVEAVQE  90
2J14_A         68  ----------------------------------------kglvwkqivngippykeisVHVFYRCQCTTVETVRE  103
gi 47825369   258  ----------------------------------------dqikckhaspiqeqnkevaIRIFQRCQFRSVEAVQE  293
gi 82240332   298  ----------------------------vltathggltehhmgsdygvwgttsisgqepqnaleLRFFQSCQSRSAEAAVRE  350
gi 122049643  216  ----------------------------------vigskivQILYSDFQARVNGICE  239
gi 585720     180  ----------------------------gtvweqlptqnltgteigVHVFYRCQCTSVETVRA  214
gi 72164991   176  -------------------------------keltekEALTKFCRGALLAIES  198
gi 115899356  264  -------------------qinkdgppqeitsrAEMAQQCFVSMEVTIEK  294
gi 16565492   175  garggticdgrggpcdsttrgrvigtdcvfitansvtdtelaadaegnrssdqevtpprgaaeIRIFNRCHYRLVEAVRE  254
```

FIG. 7E, cont'd

```
                                170         180         190         200         210         220         230         240
                       ....|....|....|....|....|....|....|....|....|....|....|....|....|....|....|....|
                           *         *         *         *         *         *         *         *
Feature 1                                                                  #  #          #  #           #
1FM6_D          91  ITEYAKSIPGFvnLDLNDQVTLLKYGVHEIIYTMLASLMNKdGVLISEGQGFMTREFLKSLRkpfgDFMEPKFEFAVKFN 170
2J14_A         104  LTEFAKSIPSFssLFLNDQVTLLKYGVHEIIYTMLASLMNKdGVLIVANGSGFVTREFLRSLRkpfsDIIEPKFEFAVKFN 183
gi 47825369    294  ITEFAKNIPGFvnLDLNDQVTLLKYGVHEAIFAMLASIVNKdGLLIVANGSGFVTREFLKSLRkpfcDFMEPKFEFAVKFN 373
gi 82240332    351  VTEFAKSIPGFtdLDLNDQVTLLKYGVIEVLIIMMSPLMNKdGTLISYGQIFMTREFLKSLRkpfcMMEPKFEFSVKFN 430
gi 122049643   240  LTEFAKRLPNFhdISLQDQVILLKYGSYETMFVLFSRLIYGeMLPKSNIYVTFNFVYQLGva-gDIMKSKFLFAKKML 318
gi 585720      215  LTDFAKRIPGFgtLYLNDQVTLLKYGVHEAIFCMLASLMNKdGLLVAGGRGFVTREFLRSLRqpfCHIMEPKFHFASKFN 294
gi 721649991   199  LAKFAKKLQEFKnLDLNDQVCLLKHAAFEVALIATSSRYASeGLWFPTDGVYFTKKMLEQLEi---SFFDGKEKFFEKMK 275
gi 115899356   295  FATFAKQLPEFrrLSSSDQLTFKGAALEVCATLSASRYYHgVYRFPEINTYIRRDVAENSPfgkVTTYTTEMMFYEMFN 374
gi 16565492    255  VTEFAKSIPGFmiLDLNDQVTLLKYGVYEVIFAMLAAQINKdGLLIAYGSAFITREFLRSLRspfCHIMEPKFEFSIRFN 334

250         260         270         280         290         300         310         320
                       ....|....|....|....|....|....|....|....|....|....|....|....|....|....|....|....|
                           *         *         *         *         *         *         *         *
Feature 1                                                                                              #
1FM6_D         171  aLELDDSDLAIFIAVIILSGDRPGLLNVKPIEDIQDNLLQALELQLKLNHPessQLFAKLLQKMTDLRQIVTEHVQLLQV 250
2J14_A         184  aLELDDSDLALFIAAIILCGDRPGLMNVPRVEAIQDTILRALEFHLQANHPdaqYLFPKLLQKMADLRQLVTEHAQMMQR 263
gi 47825369    374  aLELDDSDLAIFIAVIILSGDRPGLLNVKPIEDIQDNLLQALELQLKLNHPessQLFAKLLQKMTDLRQIVTEHVQLLQI 453
gi 82240332    431  tLELDDSDMALFLVVIILSGDRPGLLNVKPIEQLQETVLHSLELQLKLNHPdsLQLFAKLLQKMTDLRQIVTDHVHLIQL 510
gi 122049643   319  aLELTDDEMALFVAMIILCPDRPEINDRKLVERIQEKVLFALEYQLSISHPhkPRLFAHLLLKMAELRELVSKHVVMVQK 398
gi 585720      295  aLELNDSDLALFVASIILCGDRPGLINPSQVEDIQEGILGALRRHLKASHTdapFLFPKLLHKMADLRQLVTEHAELVQS 374
gi 721649991   276  kLNLTERELALFCVLSLTSPDRDELIERDEVEKFQEQVLEAIQIELRTNHSnhrMLLPRLLSLLVDLRQLVLDHIKQVQQ 355
gi 115899356   375  eLGLTDKEKAVFCTFLLYSPDREGLVDREVVERHQEHLAQILYLEVKKNHPdrsNLYAKLMDVAVALRTLVPDHLARLEQ 454
gi 16565492    335  aLSLDGTDLALYMAAIILCGDRPGLINVNPVERIQDRIIQALDLQLRKTHPespFLFPKLLQKLSDLRQLVTEHAQMVHN 414
```

FIG. 7E, cont'd

```
                        330       340
                  ....*....|....*....|......
Feature 1
1FM6_D           251 IKKtet---dmsLHPLLQEIYKDL 271
2J14_A           264 IKKtet---etsLHPLLQEIYKDM 284
gi 47825369      454 IKKtet---dmsLHPLLQEIYKDL 474
gi 82240332      511 LKKtev---dmcLHPLLQEIMKDL 531
gi 122049643     399 LADak-----dfVPPLLCEIMQDM 417
gi 585720        375 IKRtes---saaLHPLLQEIYRDM 395
gi 72164991      356 LMLmddp-sysgPPPLIKEIFGLY 378
gi 115899356     455 IKMrcnghipaePSPLLNEVYGSI 478
gi 16565492      415 IRKtea---dtaLPPLLQEIFKDM 435
```

FIG. 8A

Glucocorticoid receptor (*Homo sapiens*)

```
  1 mdskesltpg reenpssvla qergdvmdfy ktlrggatvk vsasspslav asqsdskqrr
 61 llvdfpkgsv snaqqpdisk avslsmglym getetkvmgn dlgfpqqgqi slssgetdlk
121 lleesianln rststvpenpk ssastavsaa ptekefpkth sdvsseqqhl kgqtgtnggn
181 vklyttdqst fdilqdlefs sgspgketne spwrsdllid encllsplag eddsfllegn
241 snedcklpil pdtkpkikdn gdlvissspsn vtlpqvktek edfielctpg vikqekigtv
301 ycqasfpgan ignkmsais vhgvstsgqq myhydmntas lsqqqdqkpi fnvippipvg
361 senwnrcqgs gddnltslgt lnfpgrtvfs ngyssspsmrp dvssppssss tattgpppkl
421 clvcsdeasg chygvltcgs ckvffkrave grqhnylcag rndciidkir rkncpacryr
481 kclqagmnle arktkkkikg lqqattgvsq etsenpgnkt ivpatlpqlt ptlvsllevi
541 epevlyagyd ssvpdstwri mttlnmlggr qviaavkwak aipgfrnlhl ddqmtllqys
601 wmflmafalg wrsyrqssan llcfapdlii neqrmtlpcm ydqckhmlyv sselhrlqvs
661 yeeylcmkti llssvpkdg iksqelfdei rmtyikelgk aivkregnss qnwqrfyqlt
721 kllidsmhevv enllnycfqt fldktmsief pemlaeiitn qipkysngni kkllfhqk
```

FIG. 8B

Amino acids 532-778 of *Homo sapiens* glucocorticoid receptor

```
532                                                                 tlvsllevi
541 epevlyagyd ssvpdstwri mttlnmlggr qviaavkwak aipgfrnlhl ddqmtllqys
601 wmflmafalg wrsyrqssan llcfapdlii neqrmtlpcm ydqckhmlyv sselhrlqvs
661 yeeylcmkti llssvpkdg iksqelfdei rmtyikelgk aivkregnss qnwqrfyqlt
721 kllidsmhevv enllnycfqt fldktmsief pemlaeiitn qipkysngni kkllfhqk
```

FIG. 8C
Multiple sequence alignment of ligand-binding domain of glucocorticoid receptor of various species

```
                        10        20        30        40        50        60        70        80
               ....|....|....|....|....|....|....|....|....|....|....|....|....|....|....|....|
Feature 1                                           *          *  # ##     *              *  ## #
1NHZ_A      34 TLVSLLEVIEPEVLYAGYDSSVPDSTWRIMTTLNMLGGRQVIAAVKWAKAIPGFRNLHLDDQMTLLQYSWMSLMAFALGW 113
gi_83721947 526 TLVSLLEVIEPEVLYSGYDSTLPDSSWRIMSTLNMLGGRQVVAAVKWAKAIPGFRNLHLDDQMTLLQYSWMFLMAFALGW 605
gi_1730255  530 TLISLLEVIEPEVLYSGYDSSIPDTTRRLMSSLNMLGGRQVSAVRWAKAIPGFRNLHLDDQMTLLQYSWMFLMVFALGW  609
gi_82253198 110 TMLSVLKAIEPETIYSGYDSTLPDTSSRLMSTLNRLGGQQVSAVKWAKSLPGFRNLHLDDQMILLQCSWLFLMSFSLGW  189
3CLD_A      13  TLVSLLEVIEPEVLYAGYDSSVPDSTWRIMTTLNMLGGRQVIAAVKWAKAIPGFRNLHLDDQMTLLQYSWMYLMAFALGW 92
1M2Z_A      11  TLVSLLEVIEPEVLYAGYDSSVPDSTWRIMTTLNMLGGRQVIAAVKWAKAIPGFRNLHLDDQMTLLQYSWMSLMAFALGW 90
3BQD_A      9   TLVSLLEVIEPEVLYAGYDSSVPDSTWRIMTTLNMLGGRQVIAAVKWAKAIPGFRNLHLDDQMTLLQYSWMSLMAFALGW 88

90       100       110       120       130       140       150       160
               ....|....|....|....|....|....|....|....|....|....|....|....|....|....|....|....|
Feature 1           *         #              *         #                   *                  *
1NHZ_A      114 RSYRQSSANLLCFAPDLIINEQRMTLPDMYDQCKHMLYVSSELHRLQVSYEEYLCMKTLLLLSSVPKDGLKSQELFDEIR 193
gi_83721947 606 RSYKQSNGNLLCFAPDLIINEQRMNLPCMYEQCKHMLMLVARELSRLQVSYEEYLCMKTLLLLSTIPKEGLKSQTLFEIR 685
gi_1730255  610 RSYKQTNGSILYFAPDLVITEDRMHLPFMQERCQEMLKIAGEMSSLQISYDEYLCMKVLLLMCTIPKEGLKSHALFEEIR 689
gi_82253198 190 RSYQQCNGSMLCFAPDLVINEERMRLPFMNDQCEKMLRICREFVRLQLSHEEYLCMKVLLLLSTVPKDGLKSQAVFDEIR 269
3CLD_A      93  RSYRQSSANLLCFAPDLIINEQRMTLPGMYDQCKHMLYVSSELHRLQVSYEEYLCMKTLLLLSSVPKDGLKSQELFDEIR 172
1M2Z_A      91  RSYRQSSANLLCFAPDLIINEQRMTLPCMYDQCKHMLYVSSELHRLQVSYEEYLCMKTLLLLSSVPKDGLKSQELFDEIR 170
3BQD_A      89  RSYRQSSANLLCFAPDLIINEQRMTLPCMYDQCKHMLYVSSELHRLQVSYEEYLCMKTLLLLSSVPKDGLKSQELFDEIR 168

170       180       190       200       210       220       230       240
               ....|....|....|....|....|....|....|....|....|....|....|....|....|....|....|....|
Feature 1                                                    *     # #               *
1NHZ_A      194 MTYIKELGKAIVKREGNSSQNWQRFYQLTKLLDSMHEVVENLLNYCFQTFLDKTMSIEFPEMLAEIITNQIPKYSNGNIK 273
gi_83721947 686 MTYIKELGKAIVKREGNSSQNWQRFYQLTKLLDSMHEVVENLLSFCFQTFLDKSMSIEFPEMLAEIISNQIPKYSNGNIK 765
gi_1730255  690 MTYIKELGKAIVKREGNSSQNWQRFYQLTKLLDSMHEVAENLLAFCFLSFLDKSMSIEFPDMLSEIISNQIPKYSSGNLK 769
gi_82253198 270 MTYIKELGKAIVKREENPSQNWQRFYQLTKLLDSMQEMVEGLIKFCFYTFVNKTLSVEFPEMLVEIITNQIPKFQEGGIK 349
3CLD_A      173 MTYIKELGKAIVKREGNSSQNWQRFYQLTKLLDSMHEVVENLLNYCFQTFLDKTMSIEFPEMLAEIITNQIPKYSNGNIK 252
1M2Z_A      171 MTYIKELGKAIVKREGNSSQNWQRFYQLTKLLDSMHEVVENLLNYCFQTFLDKTMSIEFPEMLAEIITNQIPKYSNGNIK 250
3BQD_A      169 MTYIKELGKAIVKREGNSSQNWQRFYQLTKLLDSMHEVVENLLNYCFQTFLDKTMSIEFPEMLAEIITNQIPKYSNGNIK 248
```

FIG. 8C, cont'd

```
Feature 1            . . . . * . .
1NHZ_A          274 KLLFHQK 280
gi 83721947     766 KLLFHQK 772
gi 1730255      770 KLLFHQK 776
gi 82253198     350 ALLFHQK 356
3CLD_A          253 KLLFHQK 259
1M2Z_A          251 KLLFHQK 257
3BQD_A          249 KLLFHQK 255
```

FIG. 9A

Vitamin D receptor (

```
  1 meamaastsl pdpgdfdrnv pricgvcgdr atgfhfnamt cegckgffrr smkrkalftc
 61 pfngdcritk dnrrhcqacr ikrcvdigmm kefiltdeev qrkremilkr keeealkdsl
121 rpklseeqqr iiailldahh ktydptysdf cqfrppvrvn dgggshpsrp nsrhtpsfsg
181 dssscsdhc itssdmmdss sfsnldlsee dsddpsvtle lsqlsmiphl adlvsysiqk
241 vigfakmipg frdltsedqi vilkssaiev imlrsnesft mddmswtcgn qdykyrvsdv
301 tkaghsleli eplikfqvgl kkinlheeeh vilmaicivs pdrpgvqdaa lieaiqdrls
361 ntlqtyircr hpppgshily akmiqkladl rslneehskq yrclsfqpec smkitplvle
421 vfgneis
```

FIG. 9B
Amino acids 124-426 of *Homo sapiens* Vitamin D receptor

```
12e      lseeqqr iiailldahh ktydptysdf cqfrppvrvn dgggshpsrp nsrhtpsfsg
181 dssscsdhc itssdmmdss sfsnldlsee dsddpsvtle lsqlsmiphl adlvsysiqk
241 vigfakmipg frdltsedqi vilkssaiev imlrsnesft mddmswtcgn qdykyrvsdv
301 tkaghsleli eplikfqvgl kkinlheeeh vilmaicivs pdrpgvqdaa lieaiqdrls
361 ntlqtyircr hpppgshily akmiqkladl rslneehskq yrclsfqpec smkitplvle
421 vfgneis
```

FIG. 9C

Multiple sequence alignment of ligand-binding domain Vitamin D receptors of various species

```
                         10         20         30         40         50         60         70         80
                ....|....|....|....|....|....|....|....|....|....|....|....|....|....|....|....|
Feature 1           *        #                *                                          *
2HBH_A         5  LSDEQMQIINSLVEAHHKTYDdSYDFVRFRPPVRegpvtrsasraaslhslsdassdsfnhspes-----vdtklnfsn  79
1SOZ_A        11  LSEEQQRIIAILLDAHHKTYDpTYSDFCQFRPPVRndgggs--------------------------------------  52
gi|147903351 125  ISDEQQKMIDILLEAHRKTFDtTYSDFNKFRPPVRenvdpfiritrsssvhtqgspsedsdvfts------spdsseehg 197
gi|3915243   147  LSEEQQKVIDTLLEAHHKTFDtTYSDFNKFRPPVRskfssrmathsssvvsqdfssedsndvfgsdafaafpepmepqmf 226

90        100        110        120        130        140        150        160
                ....|....|....|....|....|....|....|....|....|....|....|....|....|....|....|....|
Feature 1          *        #              #  # ##         *                              #   ##
2HBH_A        80  llmmyqdsgspdsseedqqsrLSMLPHLADLVSYSIQKVIGFAKMIPGFRDLTAEDQIALLKSSAIEIIMLRSNQSFSLE 159
1SOZ_A        53  -------vtlelsqLSMLPHLADLVSYSIQKVIGFAKMIPGFRDLTSEDQIVLLKSSAIEVIMLRSNESFTMD        118
gi|147903351 198  ffsaslfgqfeyssmggksgeLSMLPHIADLVSYSIQKIIGFAKMIPGFRDLIAEDQIALLKSSVIEVIMLRSNQSFSLD 277
gi|3915243   227  snidlseesdespsmnielphLPMLPHLADLVSYSIQKVIGFAKMIPGFRDLTAEDQIALLKSSAIEVIMLRSNQSFTME 306

170        180        190        200        210        220        230        240
                ....|....|....|....|....|....|....|....|....|....|....|....|....|....|....|....|
Feature 1          *  # #                    *                                     *
2HBH_A       160  DMSWSCGGPDFKYcinDVTKAGHTLELLEPLVKFQVGLKKLHEEEHVLLMAICLLSPDRPGVQDHVRIEALQDRLCDV   239
1SOZ_A       119  DMSWTCGNQDYKYrvsDVTKAGHSLELIEPLIKFQVGLKKLNLHEEEHVLLMAICIVSPDRPGVQDAALIEAIQDRLSNT 198
gi|147903351 278  DMSWTCGSEDFKYkvdDVTQAGHNMELLEPLVKFQVGLKKLDLHEEEHVLLMAICILSPDRPGLQDKALVESIQDRLSST 357
gi|3915243   307  DMSWTCGSNDFKYkvsDVTQAGHSMDLLEPLVKFQVGLKKLNLHEEEHVLLMAICILSPDRPGVQDTSLVESIQDRLSDI 386

250        260        270        280        290        300
                ....|....|....|....|....|....|....|....|....|....|....|....|
Feature 1          *                         *       #  #        *
2HBH_A       240  LQAYIRiq--hPGGRLLYAKMIQKLADLRSLNEEHSKQYRSLSFQPEHSMQLTPLVLEVFGSEV 301
1SOZ_A       199  LQTYIRcrhpPGSHLLYAKMIQKLADLRSLNEEHSKQYRCLSFQPECSMKLTPLVLEVFGNEI 262
gi|147903351 358  LQTYILCkhpPGSRLLYAKMIQKLADLRSLNEEHSKQYRSISFLPEHSMKLTPLMLEVFSDEI 421
gi|3915243   387  LQTYIRcrhpPGSRLLYAKMIQKLADLRSLNEEHSKQYRCLSFQPEHSMQLTPLVLEVGNEI  450
```

FIG. 10A

Thyroid hormone receptor alpha (*Homo sapiens*)

```
  1 meqkpskvec gsdpeensar spdgkrkrkn gqcslktsms gyipsyldkd eqcvvcgdka
 61 tgyhyrcitc egckgffrrt iqknihptys ckydsccvid kitrnqcqlc rfkkciavgm
121 amdivlddsk rvakrklieq nrerrrkeem irslgqrpep tpeewdlihi ateahrstna
181 qgshwkqrrk flpddigqsp ivsmpdgdkv dleafseftk iitpaitrvv dfakklptfs
241 elpcedqiil kgccmeims lraavrydpe sdtltlsgem avkreqlkng glgvvsdaif
301 elgkslsafn lddtevaliq avllmstdrs glicvdkiek sqeayllafe hyvnhrkhni
361 phfwpkqimk vtdlrmigac hasrflhmkv ecptelfppl flevfedqev
```

FIG. 10B

Amino acids 162-404 of *Homo sapiens* thyroid hormone receptor-alpha

```
162                                       peewdlihi ateahrstna
181 qgshwkqrrk flpddigqsp ivsmpdgdkv dleafseftk iitpaitrvv dfakklptfs
241 elpcedqiil kgccmeims lraavrydpe sdtltlsgem avkreqlkng glgvvsdaif
301 elgkslsafn lddtevaliq avllmstdrs glicvdkiek sqeayllafe hyvnhrkhni
361 phfwpkqimk vtdlrmigac hasrflhmkv ecptelfppl flev
```

FIG. 10C

Multiple sequence alignment of ligand-binding domain of thyroid hormone receptor-alpha of various species

```
Feature 1              10         20         30         40         50         60         70         80
               ....*....|....*....|....*....|....*....|....*....|....*....|....*....|....*....|
                                                        *         *      #  ## ## #    #  #
1NAV_A       17 PEEWDLIHIATEAHRSTnaqgshwkqrrkf------------lpddigqspivsmPDGDKVDLEAFSEFTKIITPAITRVVD  86
1N46_A       13 DEEWELIKTVTEAHVATnaqgshwkqkrkf------------lpedigqapivnaPEGGKVDLEAFSHFTKIITPAITRVVD  82
1BSX_A       15 DEEWELIKTVTEAHVATnaqgshwkqkrkf------------lpedigqapivnaPEGGKVDLEAFSHFTKIITPAITRVVD  84
2PIN_A        8 DEEWELIKTVTEAHVATnaqgshwkqkrkf------------lpedigqapivnaPEGGKVDLEAFSHFTKIITPAITRVVD  77
3D57_A       22 DEEWELIKTVTEAHVATnaqgshwkqkrkf------------lpedigqapivnaPEGGKVDLEAFSHFTKIITPAITRVVD  91
gi_151413583 179 TCPKKVNRYYLNGSPKPgmpvpeaprppvv------------qngvvreadssgaMDDDMVDQDIFSHLAEVITPAIIKVVE 248
gi_134319114 159 AEEWELIHVTEAHRSTnaqgshwkqkrkf-------------lpedigqspmasmPDGDKVDLEAFSEFTKIITPAITRVVD 228
gi_6175061   170 SEEWELIRIVTEAHVATnaqgshwkqrrkf------------lpedigqspmasmPDGDKVDLEAFSEFTKIITPAITRVVD 239
gi_82274155  223 SDPSGLIPDPLLDSRATsstfpqiltcpilrpgfsrpadappdkigqspvaptSDGDKVDLEAFSEFTKIITPAITRVVD 302
gi_117532680 186 DHEEALIRAILVAHKQTshmyrres------------------ssgeesePDSKKQKLEDEKPLSEIMTPSIVKVVE 244
gi_586092    216 DEEWELIKTVTEAHVATnaqgshwkqkrkf------------lpedigqapivnaPEGGKVDLEAFSHFTKIITPAITRVVD 285
gi_215273960 141 QEEWEMIRVTEAHMATnaqgnhwkqkrkflsavg-vkeakpedigsapivnaPEGNKVDIEAFSQFTKIITPAITRVVD 219

90        100        110        120        130        140        150        160
               ....*....|....*....|....*....|....*....|....*....|....*....|....*....|....*....|
                                    #  ###                                ###         #  #
1NAV_A       87 FAKKLPMFsELPCEDQIILLKGCCMEIMSLRAAVRYDPESDTLTLSGEMaVKREQLKNGGLGVVSDAIFELGKSLSaFNL 166
1N46_A       83 FAKKLPMFcELPCEDQIILLKGCCMEIMSLRAAVRYDPESETLTLNGEMaVTRGQLKNGGLGVVSDAIFDLGMSLSsFNL 162
1BSX_A       85 FAKKLPMFcELPCEDQIILLKGCCMEIMSLRAAVRYDPESETLTLNGEMaVTRGQLKNGGLGVVSDAIFDLGMSLSsFNL 164
2PIN_A       78 FAKKLPMFcELPCEDQIILLKGCCMEIMSLRAAVRYDPESETLTLNGEMaVTRGQLKNGGLGVVSDAIFRLGMSLSsFNL 157
3D57_A       92 FAKKLPMFcELPCEDQIILLKGCCMEIMSLRAAVRYDPESETLTLNGEMaVTRGQLKNGGLGVVSDAIFRLGMSLSsFNL 171
gi_151413583 249 FAKQIPGFtKLVPDDQVALLKNCCFEVMCLRAASRFDKQRRTITMFGGLtVTKEQVSQGGLGRLAEPLFEFAEGLSqLHL 328
gi_134319114 229 FAKKLPMFsELPCEDQIILLKGCCMEIMSLRAAVRYDPESETLTLSGEMaVKREQLKNGGLGVVSDAIFELGKSLSaFNL 308
gi_6175061   240 FAKKLPMFsELTCEDQIILLKGCCMEIMSLRAAVRYDPDSETLTLSGEMaVKREQLKNGGLGVVSDAIFDLGRSLAaFNL 319
gi_82274155  303 FAKKLPMFsELPCEDQIILLHDDQIILLKTCCMEIMCLRAAMRYDPESETLTLSGEMaVKREQLKNGGLGVVSDAIFDLGKSLAqFNL 382
gi_117532680 245 FAKRIPGFtGLHHDDQIILLHKTCCMEIMCLRVAQKFDPDSQKLILSNGLrVGKSDMDHGVLSELIEPIFDFAVSMSrLQL 324
gi_586092    286 FAKKLPMFcELPCEDQIILLKGCCMEIMSLRAAVRYDPESETLTLNGEMaVTRGQLKNGDMHGVLSNGLrVGKSDMDHGVLSELIEPIFDFAVSMSrLQL 365
gi_215273960 220 FAKKLPMFcELPCEDQIILLKGCCMEIMSLRAAVRYDPESDTLTLNGEMaVTRGQLKNGGLGVVSLSSFNL 299
```

FIG. 10C, cont'd

```
                          170       180       190       200       210       220       230       240
                 ....*....|....*....|....*....|....*....|....*....|....*....|....*....|....*....|
Feature 1
1NAV_A       167 DDTEVALLQAVLLMSTDRs---------------------------------GLLCVDKIEKSQEAYLLAFEHYVNhrKHNIPHFW 219
1N46_A       163 DDTEVALLQAVLLMSSDRp---------------------------------GLACVERIEKYQDSFLLAFEHYINyrKHHHVTHFW 215
1BSX_A       165 DDTEVALLQAVLLMSSDRp---------------------------------GLACVERIEKYQDSFLLAFEHYINyrKHHHVTHFW 217
2PIN_A       158 DDTEVALLQAVLLMSSDRp---------------------------------GLACVERIEKYQDSFLLAFEHYINyrKHHHVTHFW 210
3D57_A       172 DDTEVALLAALLVVADRP----------------------------------GLACVERIEKYQDSFLLAFEHYINyrKHHHVTHFW 224
gi_151413583 329 DDTEVALLQAVLLMSSDRt---------------------------------GVQDQESIDRLQDILLTAYKNYITrqRPHQPVLW 380
gi_134321914 309 DDTEVALLQAVLLMSSDRt---------------------------------GLICVDKIEKCQETYLLAFEHYINyrKHNIPHFW 361
gi_6175061   320 DDTEVALLQAVLLMSSDRt---------------------------------GLICTDKIEKCQETYLLAFEHYINhrKHNIPHFW 372
gi_82274155  383 DDTEVALLQAVLLMSSGNrrrgrprpspapgstsssssssdrsGLTCTDKIEKCQETYLLAFEHYINyrKHNIPHFW 462
gi_115732680 325 TETEMALLAAVLLIAGDRp---------------------------------GLKEAKLVETLQDSLLTAFQHFINesRPKTPVHW 377
gi_586092    366 DDTEVALLQAVLLMSSDRp---------------------------------GLACVERIEKYQDSFLLAFEHYINyrKHHHVTHFW 418
gi_215273960 300 DDSEVALLQAVILLSSDRp---------------------------------GLTSVERIERCQEEFLLAFEHYINyrKHKVAHFW 352

250       260       270       280
                 ....*....|....*....|....*....|....*....|
                          #         #         #
Feature 1
1NAV_A       220 PKLLMKVTDLRMIGACHASRFLHMKVECPTELfPPLFLEV 259
1N46_A       216 PKLLMKVTDLRMIGACHASRFLHMKVECPTELfPPLFLEV 255
1BSX_A       218 PKLLMKVTDLRMIGACHASRFLHMKVECPTELfPPLFLEV 257
2PIN_A       211 PKLLMKVTDLRMIGACHASRFLHMKVECPTELfPPLFLEV 250
3D57_A       225 PKLLMKVTDLRMIGACHASRFLHMKVECPTELfPPLFLEV 264
gi_151413583 381 GKILMKVTDLRALSVAHAEQVKLVKMECTNDI-PPLFLEM 419
gi_134321914 362 PKLLMKVTDLRMIGACHASRFLHMKVECPTELfPPLFLEV 401
gi_6175061   373 PKLLMKVTDLRMIGACHASRFLHMKVECPTELfPPLFLEV 412
gi_82274155  463 PKLLMKVTDLRMIGACHASRFLHMKVECPNELfPPLFLEV 502
gi_115732680 378 AKILMKITDLRTISARHAERIMCIKLDRPNEI-PQIFLEM 416
gi_586092    419 PKLLMKVTDLRMIGACHASRFLHMKVECPTELfPPLFLEV 458
gi_215273960 353 PKLLMKVTDLRMIGACHASRFLHMKVECPTELfPPLFLEV 392
```

FIG. 11A

Retinoic acid receptor-beta (*Homo sapiens*)

```
  1 mfdcmdvlsv spgqildfyt aspsscmlqe kalkacfsgl tqtewqhrht aqsietqsts
 61 seelvpspps plppprvykp cfvcqdkssg yhygvsaceg ckgffrrsiq knmiytchrd
121 kncvinkvtr nrcqycriqk cfevgmskes vrndrnkkkk etskqectes yemtaelddl
181 tekirkahqe tfpslcqigk yttnssadhr vridlglwdk fselatkcii kivefakrlp
241 gftgltiadq itllkaacid plemddtetg llsaiclicg drqdleeptk vdkiqepile hnagfgpltd alkiyirkrr
301 lvftfanqll plemddtetg llsaiclicg drqdleeptk vdkiqepile alkiyirkrr
361 pskphmfpki lmkitdlrsi sakgaervit lkmeipgsmp pliqemiens eghepltpss
421 sgntaehsps ispssvensg vsqsplvq
```

FIG. 11B

Amino acids 179-409 of *Homo sapiens* retinoic acid receptor-beta

```
179                                                                  dl
181 tekirkahqe tfpslcqigk yttnssadhr vridlglwdk fselatkcii kivefakrlp
241 gftgltiadq itllkaacid plemddtetg llsaiclicg drqdleeptk hnagfgpltd
301 lvftfanqll plemddtetg llsaiclicg drqdleeptk vdkiqepile alkiyirkrr
361 pskphmfpki lmkitdlrsi sakgaervit lkmeipgsmp pliqemien
```

FIG. 11C

Multiple sequence alignment of ligand-binding domain of retinoic acid receptor-beta of various species

```
                        ....|....|....|....|....|....|....|....|
                                 10        20        30        40        50        60        70        80
                        ....|....|....|....|....|....|....|....|....|....|....|....|....|....|....|....|
Feature 1                    *              *         *         *    #  ##   #  *         *         *
1XAP_A            32    DLTEKIRKAHQETFPslcqLGKYTTNSsadh---rvrlDLGLWDKFSELATKCIIKIVEFAKRLPGFTgLTIADQITLLK   108
gi 122049638    400    ALVTSVHKFHVETFPlsseLKKYQIPSppivkdtsakTDSNLWEKFAELSTKCIVKIVEFAKGIPGFQdFTIADQITLLK   479
gi 3041719      186    DLTEKIRKAHQETFPslcqLGKYTTNSsadh---rvrLDLGLWDKFSELATKCIIKIVEFAKRLPGFTsLTIADQITLLK   262
gi 285587670    209    ELIQKVSKAHQETFPslcqLGKYTTNSsadq---rvqLDLGLWDKFSELSTKCIIKIVEFAKRLPGFTtLTIADQITLLK   285
gi 118572702    176    ELVNKVSKAHQETFPslcqLGKYTTNSssdh---riqLDLGLWDKFSELSTKCIIKIVEFAKRLPGFLsLSTQDQITLLK   252
gi 115681476    134    DILQEVLRAHRDTFPqrplHPIHNAVSagn----idiDMVMFDYVTDMSSRAIVMVVDFAKKLPGFLsLSTQDQITLLK    208
gi 219413150    179    TIITTVREAHMATLPdmgkLPKYKVKNaaeq---rgpTDIELWQHFSDLCTETIIKIVQFAKKVPGFTfFGTADQITLLK    255
1XDK_B           34    DLTEKIRKAHQETFPslcqLGKYTTNSsadh---rvrLDLGLWDKFSELATKCIIKIVEFAKRLPGFTgLTIADQITLLK   110
1DKF_B            5    ELIEKVRKAHQETFPalcqLGKYTTNNsseq---rvsLDIDLWDKFSELSTKCIIKTVEFAKQLPGFTtLTIADQITLLK    81

90       100       110       120       130       140       150       160
                        ....|....|....|....|....|....|....|....|....|....|....|....|....|....|....|....|
Feature 1                *  # ##     #         *       ##                  *           *
1XAP_A           109    AACLDILILRICTRYTPEQDTMTFSdGLTLNRTQMHNAGFGPLTDLVFTFANQLiplEMDDTETGLLSAICLICGDRqdL   188
gi 122049638    480    CACLEVLFLRICSRFSPEHDTMTFSdGLTLTRKQMRVCGEGPITEQVESFAQSLhpLNADATEIGLLSAICLVSADRvdL   559
gi 3041719      263    AACLDILILRICTRYTPEQDTMTFSdGLTLNRTQMHNAGFGPLTDLVFTFANQLiplEMDDTETGLLSAICLICGDRqdL   342
gi 285587670    286    SACLDILMLRICTRYTPEQDTMTFSdGLTLNRTQMHNAGFGPLTDLVFSFADQLiplEMDDTETGLLSAICLICGDRmdL   365
gi 118572702    253    SACLDILMLRICTRYTPEQDTMTFSdGLTLNRTQMHNAGFGPLTDLVFAFAGQLiplEMDDTETGLLSAICLICGDRmdL   332
gi 115681476    209    ASCLDILMILRICSRFNPQDASVFTFtGLTLTQGQLKAGGFGSLLDVIFTFASSLsrMHIDETEIALLSAICLISEDRtgL   288
gi 219413150    256    AACLDILILRLATRLDKESDTVTFInGMMLSRTQMHNAGFGPLTDGVFTFAEGMqkLLFDETEIGLMCSICLVCGDRqgL   335
1XDK_B          111    AACLDILILRICTRYTPEQDTMTFSdGLTLNRTQMHNAGFGPLTDLVFTFANQLiplEMDDTETGLLSAICLICGDRqdL   190
1DKF_B           82    AACLDILILRICTRYTPEQDTMTFSdGLTLNRTQMHNAGFGPLTDLVFAFANQLiplEMDDAETGLLSAICLICGDRqdL   161
```

FIG. 11C, cont'd

```
                       170        180        190        200        210        220        230
              ....*....|....*....|....*....|....*....|....*....|....*....|....*....|....*....
Feature 1                                                              ##      #                  #
1XAP_A      189 EEPTKVDKLQEPLLEALKIYIRKRRPskphMFPKILMKITDLRSISAKGAERVITL-KMEIPGSMPPLIQEMLEN 262
gi_122049638 560 EEPDKVELLQESLVEGLKYARKRRPhtpqVFPKLIIKISDLRSISLKGADRVTVkTEIPCGAMPPLMSEMLEN 634
gi_3041719   343 EEPMKVDKLQEPLLEALKIYIRKRRPnkphMFPKILMKITDLRSISAKGAERVITL-KMEIPGSMPPLIQEMLEN 416
gi_285587767 366 EEPEKVEKLQEPLLEALKFYARRRRPdkpyMFPRMLMKITDLRGISTKGAERAITL-KLEIPGPMPPLIREMLEN 439
gi_118572702 333 EEPERVDRLQEPLLEALKIYARRRRPnkphMFPRMLMKITDLRGISTKGAERAITL-KMEIPGPMPPLIREMLEN 406
gi_115681476 289 EDAPRIEKMQEPLLEGLRLYVRKRRPkeshFFAKLLMKITDLRCISVKSAEKVFDM-KVEFVKEMPALISEMIDK 362
gi_219413150 336 EDIQRAENLQEPLLEALKAYSRRRIPddpqRFPKMIMKITDLRSISSKGAERVITL-KMELSSPMPPLIAEIWEK 409
1XDK_B       191 EEPTKVDKLQEPLLEALKIYIRKRRPskphMFPKILMKITDLRSISAKGAERVITL-KMEIPGSMPPLIQEMLEN 264
1DKF_B       162 EQPDRVDMLQEPLLEALKVYVRKRRPsrphMFPKMLMKITDLRSISAKGAERVITL-KMEIPGSMPPLIQEMLEN 235
``` meso is an irrelevant antigen

| Drug | NHR LBD | Coactivator |
|---|---|---|
| rosiglitazone, pioglitazone, farglitazar, aleglitazar, fenofibric acid | PPARg | SRC1, SRC2, SRC3, TRAP220 |
| tamoxifen, raloxifene, bazedoxifene, lasofoxifene | ERa, ERb (WT and many mutants) | CoRNR, αβV, TA1 |
| eplerenone, spironolactone | MR (WT, S810L) | SRC1, PGC1A, TRAP220 |
| mifepristone, asoprisnil | PR | NCoR |
| enzalutamide, ARN-509, cyproterone acetate, flutamide | AR (WT, T877A, F876L) | SRC1, SRC2, SRC3, TRAP220 |
| drospirenone | PR | SRC1, SRC2, SRC3, TRAP220, NR0B1, PGC1B, NRIP1, EA2, EAB1 |
| sobetirome | TRb | SRC1, SRC2, SRC3, TRAP220 |
| ethinyl estradiol | ERa, ERb | SRC1, SRC2, SRC3, TRAP220, NR0B1, PGC1B, NRIP1, EA2, EAB1 |

FIG. 19

FIG. 20A
Lyn kinase

```
  1 mgcikskgkd slsddgvdlk tqpvrntert iyvrdptsnk qqrpvpesql lpgqrfqtkd
 61 peegdivva lypydgihpd dlsfkkgekm kvleehgeww kakslitkke gfipsnyvak
121 lntleteewf fkditrkdae rqllapgnsa gaflireset lkgsfslsvr dfdpvhgdvi
181 khykirsldn ggyyisprit fpcisdmikh yqkqadglcr rlekacispk pqkpwdkdaw
241 eipresiklv krlgagqfge vwmgyynnst kvavktlkpg tmsvqaflee anlmktlqhd
301 klvrlyavvt reepiyiite ymakgslldf lksdeggkvl lpklidfsaq iaegmayier
361 knyihrdlra anvlvseslm ckiadfglar viedneytar egakfpikwt apeainfgcf
421 tiksdvwsfg illyeivtyg kipypgrtna dvmtalsqgy rmprvencpd elydimkmcw
481 kekaeerptf dylqsvlddf ytategqyqq qp
```

FIG. 20B
N-terminal portion of Lyn kinase (Y211-E393)

```
211                                  yqkqadglcr rlekacispk pqkpwdkdaw
241 eipresiklv krlgagqfge vwmgyynnst kvavktlkpg tmsvqaflee anlmktlqhd
301 klvrlyavvt reepiyiite ymakgslldf lksdeggkvl lpklidfsaq iaegmayier
361 knyihrdlra anvlvseslm ckiadfglar vie
```

FIG. 20C
C-terminal portion of Lyn kinase (D394-P512)

```
394                         dneytar egakfpikwt apeainfgcf
421 tiksdvwsfg illyeivtyg kipypgrtna dvmtalsqgy rmprvencpd elydimkmcw
481 kekaeerptf dylqsvlddf ytategqyqq qp
```

FIG. 21
Fak kinase

```
   1 maaayldpnl nhtpssstkt hlgtgtersp gamervlkvf hyfessnept twasiirhgd
  61 atdvrgiiqk ivdshkvkhv acygfrishl rseevhwlhv dmgvssvrek yelahppeew
 121 kyelrirylp kgflnqfted kptlnffyqq vksdymleia dqvdqdialk lgcleirrsy
 181 wemrgnalek ksnyevlekd vglkrffpks lldsvkaktl rkliqqtfrq faninreesi
 241 lkffeilspv yrfdkecfkc algsswiisv elaigpeegi syltdkgcnp thladfnqvq
 301 tiqysnsedk drkgmlqlki agapepltvt apsitiaenm adlidgycrl vngatqsfii
 361 rpqkegeral psipklanne kqgmrthavs vsetddyaei ideedtytmp strdyeiqre
 421 rielgrcige gqfgdvhqgv ylspenpala vaiktcknct sdsvrekflq ealtmrqfdh
 481 phivkligvi tenpvwiime lctlgeirsf lqvrkysldl aslilyayql stalaylesk
 541 rfvhrdiaar nvlvssndcv klgdfglsry medstyykas kgklpikwma pesinfrrft
 601 sasdvwmfgv cmweilmhgv kpfqgvknnd vigrienger lpmppncppt lyslmtkcwa
 661 ydpsrrprft elkaqlstil eeekvqqeer mrmesrrqat vswdsggsde appkpsrpgy
 721 psprssegfy pspqhmvqtn hyqisgypgs hgipamagsi ypgqaslldq telwnhrpqe
 781 msmwqpsved saaldlrgmg qvlpphlmee rlirqqeme edqrwlekee rflkpdvrls
 841 rgsidredgs fqgptgnqhi yqpvgkpdpa appkkpprpg apghlsnlss isspaesyne
 901 gvkpwrlqpq eisppptanl drsndkvyen vtglvkavie msskiqpapp eeyvpmvkev
 961 glairtllat vdetipilpa sthreiemaq kllnsdlgel iskmklaqqy vmtslqqeyk
1021 kqmltaahal avdaknlldv idqarlkmlg qtrph
```

FIG. 22A
FXR

```
  1 mgskmnlieh shlpttdefs fsenlfgvlt eqvagplgqn levepysqys nvqfpqvqpq
 61 issssyysnl gfypqqpeew yspgiyelrr mpaetlyqge tevaempvtk kprmgasagr
121 ikgdelcvvc gdrasgyhyn altcegckgf frrsitknav ykcknggncv mdmymrrkcq
181 ecrlrckcem gmlaeclite iqckskrlrk nvkqhadqtv nedsegrdlr qvtsttkscr
241 ekteltpdqq tllhfimdsy nkqrmpqeit nkilkeefsa eenfliltem atnhvqvlve
301 ftkklpgfqt ldhedqiall kgsaveamfl rsaeifnkkl psghsdllee rirnsgisde
361 yitpmfsfyk sigelkmtqe eyalltaivi lspdrqyikd reaveklqep lldvlqklck
421 ihqpenpqhf acllgritel rtfnhhhaem lmswrvndhk ftpllceiwd vq
```

FIG. 22B
FXR LBD

```
237                                                                kscr
241 ekteltpdqq tllhfimdsy nkqrmpqeit nkilkeefsa eenfliltem atnhvqvlve
301 ftkklpgfqt ldhedqiall kgsaveamfl rsaeifnkkl psghsdllee rirnsgisde
361 yitpmfsfyk sigelkmtqe eyalltaivi lspdrqyikd reaveklqep lldvlqklck
421 ihqpenpqhf acllgritel rtfnhhhaem lmswrvndhk ftpllceiwd vq
```

FIG. 23A
LXR-alpha

```
  1 mslwlgapvp dippdsavel wkpgaqdass qaqggsscil reearmphsa ggtagvglea
 61 aeptalitra eppsepteir pqkrkkgpap kmlgnelcsv cgdkasgfhy nvlscegckg
121 ffrrsvikga hyichsgghc pmdtymrrkc qecrlrkcrg agmreecvls eeqirlkkik
181 rqeeeqahat slppprasspp qilpqispeq lgmieklvaa qqqcnrrsfs drlrvtpwpm
241 apdphsrear qqrfahftel aivsvqeivd fakqlpgflq lsredqiall ktsaievmll
301 etsrrynpgs esitflkdfs ynredfakag lqvefinpif efsramnelq lndaefalli
361 aisifsadrp nvqdqlqver lqhtyvealh ayvsihhphd rlmfprmimk lvsirtlssv
421 hseqvfairl qdkklpplis eiwdvhe
```

FIG. 23B
LXR-alpha LBD

```
182 qeeeqahat slppprasspp qilpqispeq lgmieklvaa qqqcnrrsfs drlrvtpwpm
241 apdphsrear qqrfahftel aivsvqeivd fakqlpgflq lsredqiall ktsaievmll
301 etsrrynpgs esitflkdfs ynredfakag lqvefinpif efsramnelq lndaefalli
361 aisifsadrp nvqdqlqver lqhtyvealh ayvsihhphd rlmfprmimk lvsirtlssv
421 hseqvfairl qdkklpplis eiwdvhe
```

FIG. 24A
ROR-gamma

```
  1 mrtqievipc kicgdkssgi hygvitcegc kgffrrsqrc naaysctrqq ncpidrtsrn
 61 rcqhcrlqkc lalgmsrdav kfgrmskkqr dslhaevqkq lqqrqqqqe pvvktppaga
121 qgadtlytyl glpdgqlplg sspdipeasa cppglikasg sgpsysnnla kagingasch
181 leyspergka egresfystg sqltpdrcgi rfeehrhpgi gelgqgpdsy gspsfrstpe
241 apyaslteie hlvqsvcksy retcqirled lirqrsnifs reevtgyqrk smwemwerca
301 hhlteaiqyv vefakrlsgf melcqndqiv likagamevv lvrmcrayna dnrtvffegk
361 yggmelfral gcselissif dfshslsaih fsedeialyt alvlinahrp glqekrkveq
421 lqynlelafh hhlckthrqs ilakippkgk lrslcsqhve rlqifqhihp ivvqaafppl
481 ykelfstete spvglsk
```

FIG. 24B
ROR-gamma LBD

```
237                                                              stpe
241 apyaslteie hlvqsvcksy retcqirled lirqrsnifs reevtgyqrk smwemwerca
301 hhlteaiqyv vefakrlsgf melcqndqiv likagamevv lvrmcrayna dnrtvffegk
361 yggmelfral gcselissif dfshslsaih fsedeialyt alvlinahrp glqekrkveq
421 lqynlelafh hhlckthrqs ilakippkgk lrslcsqhve rlqifqhihp ivvqaafppl
481 ykelfstete spvglsk
```

FIG. 25A
RXR-alpha

```
  1 mdtkhflpld fstqvnsslt sptgrgsmaa pslhpslgpg igspgqlhsp istlsspinq
 61 mgppfsviss pmgphsmsvp ttptlgfstg spqlsspmnp vsssedikpp iglngvlkvp
121 ahpsgnmasf tkhicaicgd rssgkhygvy scegckgffk rtvrkdityt crdnkdcliid
181 krqrnrcqyc ryqkclamgm kreavqeerq rgkdrnenev estssanedm pverileael
241 avepktetyv eanmglnpss pndpvtnicq aadkqlftlv ewakriphfs elpiddqvil
301 lragwnelli asfshrsiav kdgillatgl hvhrnsahsa gvgaifdrvl telvskmrdm
361 qmdktelgcl raivlfnpds kglsnpaeve alrekvyasl eayckhkype qpgrfakill
421 rlpalrsigl kclehlfffk ligdtpidtf lmemleaphq mt
```

FIG. 25B
RXR-alpha LBD

```
225                                                   sanedm pverileael
241 avepktetyv eanmglnpss pndpvtnicq aadkqlftlv ewakriphfs elpiddqvil
301 lragwnelli asfshrsiav kdgillatgl hvhrnsahsa gvgaifdrvl telvskmrdm
361 qmdktelgcl raivlfnpds kglsnpaeve alrekvyasl eayckhkype qpgrfakill
421 rlpalrsigl kclehlfffk ligdtpidtf lmemleaphq mt
```

FIG. 26A
PXR

```
  1 mevrpkeswn hadfvhcedt esvpgkpsvn adeevgqpqi crvcgdkatg yhfnvmtceg
 61 ckgffrramk rnarlrcpfr kgaceitrkt rrqcqacrlr kclesgmkke mimsdeavee
121 rralikrkks ertgtqplgv qglteeqrmm irelmdaqmk tfdttfshfk nfrlpgvlss
181 gcelpeslqa psreeaakws qvrkdlcslk vslqlrgedg svwnykppad sggkeifsll
241 phmadmstym fkgiisfakv isyfrdlpie dqislikgaa felcqlrfnt vfnaetgtwe
301 cgrlsycled taggfqqill epmikfhyml kklqlheeey vlmqaislfs pdrpgvlqhr
361 vvdqlqeqfa itliksyiecn rpqpahrflf lkimamltel rsinaqhtqr llriqdihpf
421 atplmqelfg itgs
```

FIG. 26B
PXR LBD

```
130          s ertgtqplgv qglteeqrmm irelmdaqmk tfdttfshfk nfrlpgvlss
181 gcelpeslqa psreeaakws qvrkdlcslk vslqlrgedg svwnykppad sggkeifsll
241 phmadmstym fkgiisfakv isyfrdlpie dqislikgaa felcqlrfnt vfnaetgtwe
301 cgrlsycled taggfqqill epmikfhyml kklqlheeey vlmqaislfs pdrpgvlqhr
361 vvdqlqeqfa itliksyiecn rpqpahrflf lkimamltel rsinaqhtqr llriqdihpf
421 atplmqelfg itgs
```

FIG. 27

| Receptor | Protein Sequence |
|---|---|
| CD80 | RCRERRRNERLRRESVRPV |
| PD1L | RKGRMMDVKKCGIQDTNSKKQSDTHLEET |
| TRML2_human (TLT2) | KKRHMASYSMCSDPSTRDPPGRPEPYVEVYLI |
| ICOS_human | TKKKYSSSVHDPNGEYMFMRAVNTAKKSRLTDVTL |
| TNF14_human (HVEM) | MEESVVRPSVFVVDGQTDIPFTRLGRSHRRQSCSV |
| CTLA4_human | SLSKMLKKRSPLTTGVYVKMPPTEPECEKQFQPYFIPIN |
| CD7_human | ARTQIKKLCSWRDKNSAACVVYEDMSHSRCNTLSSPNQYQ |
| TNR9_human (CD137, 41BB) | KRGRKKLLYIFKQPFMRPVQTTQEEDGCSCRFPEEEEGGCEL |
| CD28 | WVRSKRSRLLHSDYMNMTPRRPGPTRKHYQPYAPPRDFAAYRS |
| CD27_human | HQRRKYRSNKGESPVEPAEPCHYSCPREEEGSTIPIQEDYRKPEPACSP |
| LAG3_human | RRQWRPRRFSALEQGIHPPQAQSKIEELEQEPEPEPEPEPEPEPEPEQL |
| TNR18_human (GITR) | HIWQLRSQCMWPRETQLLLEVPPSTEDARSCQFPEEERGERSAEEKGRLGDLWV |
| CD226_human (DNAM-1) | NRRRRRERRDLFTESWDTQKAPNNYRSPISTSQPTNQSMDDTREDIYVNYPTFSRRPKTRV |
| TNR5_human (CD40) | KKVAKKPTNKAPHPKQEPQEINFPDDLPGSNTAAPVQETLHGCQPVTQEDGKESRISVQERQ |
| HAVR(TIM-3) | KWYSHSKEKIQNLSLISLANLPPSGLANAVAEGIRSEENIYTIEENVYEVEEPNEYYCYVSSRQQPSQPLGCRFAMP |
| TIGIT_human | RKKKALRIHSVEGDLRRKSAGQEEWSPSAPSPPGSCVQAEAAPAGLCGEQRGEDCAELHDYFNVLSYRSLGNCSFFTETG |
| CRTAM_human | KLRKAHVIWKKENEVSEHTLESYRSRSNNEETSSEEKNGQSSHPMRCMNYITKLYSEAKTKRKENVQHSKLEEKHIQVPESIV |
| PDCD1_human (PD-1) | ICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL |
| LAIR1_human | HRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH |
| CXAR_human (CAR) | CCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV |
| BTLA_human | CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS |
| CD2 | TKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN |
| CD244_human (2B4) | WRRKREKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS |
| TNR8_human (CD30) | RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK |
| TNR25_HUMAN (DR3) | TYRHCWPHKPLVTADEAGMEALTPPPATHLSPLDSAHTLAPPDSSEKICTVQLVGNSWTPGYPETQEALCPQVTWSWDQLPSRALGPAAAPTLSPESPAGSPAMMLQ |
| OX40 | ALYLLRRDQRLPPDAHKPPGGGSFRTPIQEEQADAHSTLAKI |
| NKG2D | MGWIRGRRSRHSWEMSEFHNYNLDLKKSDFSTRWQKQRCPVVKSKCRENAS |
| TIM-1 | KKYFFKKEVQQLSVSFSSLQIKALQNAVEKEVQAEDNIYIENSLYATD |

FIG. 27 (cont'd)

| Receptor | Protein Sequence |
|---|---|
| CD160 | SGFLQEKVWVMLVTSLVALQAL |
| BAFF-R | SWRRRQRRLRGASSAEAPDGKDAPEPLDKVIILSPGISDATAPAWPPPGEDPGTTPPGHSVPVPAT ELGSTELVTTKTAGPEQQ |
| TACI | ACFLKKRGDPCSCQPRSRPRQSPAKSSQDHAMEAGSPVSTSPEPVETCSFCFPECRAPTQESAVTPG TPDPTCAGRWGCHTRTTVLQPCPHIPDSGLGIVCVPAQEGGPGA |
| CD72 | MAEAITYADLRFVKAPLKKSISSRLGQDPGADDDGEITYENVQVPAVLGVPSSLASSVLGDKAAVKSE QPTASWRAVTSPAVGRILPCRTTCLRY |
| CD22 | KLQRRWKRTQSQQGLQENSSGQSFFVRNKKVRRAPLSEGPHSLGCYNPMMEDGISYTTLRFPEMN IPRTGDAESSEMQRPPPDCDDTVTYSALHKRQVGDYENVIPDFPEDEGIHYSELIQFGVGERPQAQE NVDYVILKH |
| CD96 | RKWCQYQKEIMERPPPFKPPPPPIKYTCIQEPNESDLPYHEMETL |
| NTB-A | LRKRRDSLSLSTQRTQGPAESARNLEYVSVSPTNNTVYASVTHSNRETEIWTPRENDTITIYSTINHSKE SKPTFSRATALDNV |
| CRACC | WFLKRERQEEYIEEKKRVDICRETPNICPHSGENTEYDTIPHTNRTILKEDPANTVYSTVEIPKKMENP HSLLTMPDTPRLFAYENVI |
| Siglec-3.7.9 | KTHRRKAARTAVGRNDTHPTTGSASPKHQKKSKLHGPTETSSCSGAAPTVEMDEELHYASLNFHGM NPSKDTSTEYSEVRTQ |
| KLRG1 | MTDSVIYSMLELPTATQAQNDYGPQQKSSSSRPSCSCL |
| NKR-P1A | MDQQAIYAELNLPTDSGPESSSPSSLPRDVCQGSPWHQFALKLSC |
| ILT2 | LRHRRQGKHWTSTQRKADFQHPAGAVGPEPTDRGLQWRSSPAADAQEENLYAAVKHTQPEDGV EMDTRSPHDEDPQAVTYAEVKHSRPRREMASPPSPLSGEFLDTKDRQAEEDRQMDTEAAASEAPQ DVTYAQLHSLTLRREATEPPPSQEGPSPAVPSIYATLAIH |
| KIR2DL1 | RWCSNKKNAAVMDQESAGNRTANSEDSDEQDPQEVTYTQLNHCVFTQRKITRPSQRPKTPPTDIIV YTELPNAESRSKVVSCP |
| KIR3DL1 | HLWCSNKKNAAVMDQEPAGNRTANSEDSDEQDPEEVTYAQLDHCVFTQRKITRPSQRPKTPPTDT ILYTELPNAKPRSKVVSCP |
| CD94-NKG2A | MAVFKTTLWR |
| CD300b | KGSQRVPEEPGEQPIYMNFSEPLTKDMAT |
| CD300e | VNRPQWAPPGR |
| TREM1 | VTLRSFVP |
| TREM2 | AAWHGQKPGTHPPSELDCGHDPGYQLQTLPGLRDT |
| ILT7 | QHSQRSPPRCSQEANSRKDNAPFRVVEPWEQI |
| ILT3 | QHWRQGKHRTLAQRQADFQRPPGAAEPEPKDGGLQRRSSPAADVQGENFCAAVKNTQPEDGVE MDTRQSPHDEDPQAVTYAKVKHSRPRREMASPPSPLSGEFLDTKDRQAEEDRQMDTEAAASEAP QDVTYAQLHSFTLRQKATEPPPSQEGASPAEPSVYATLAIH |
| ILT4 | LRHRRQGKHWTSTQRKADFQHPAGAVGPEPTDRGLQWRSSPAADAQEENLYAAVKDTQPEDGV EMDTRAAASEAPQDVTYAQLHSLTLRRKATEPPPSQEREPPAEPSIYATLAIH |
| TLT-1 | MAKRKQGNRLGVCGRFLSSRVSGMNPSSVVHHVSDSGPAAELPLDVPHIRLDSPPSFDNTTYTSLPL DSPSGKPSLPAPSSLPPLPPKVLVCSKPVTYATVIFPGGNKGGGTSCGPAQNPPNNQTPSS |
| CD200R | KVNGCRKYKLNKTESTPVVEEDMQPYASYTEKNNPLYDTTNKVKASEALQSEVDTDLHTL |
| CD300a | RMFQKWIKAGDHSELSQNPKQAATQSELHYANLELLMWPLQEKPAPPREVEVEYSTVASPREELHY ASVVFDSNTNRIAAQRPREEEPDSDYSVIRKT |
| CD300f | WRMMKYQQKAAGMSPEQVLQPLEGDLCYADLTLQLAGTSPQKATTKLSSAQVDQVEVEYVTMAS LPKEDISYASLTLGAEDQEPTYCNMGHLSSHLPGRGPEEPTEYSTISRP |
| DC-SIGN | MSDSKEPRLQQLGLLEEEQLRGLGFRQTRGYKSLAGC |
| B7-2 | RKSSGGKGGSYSQAACSDSAQGSDVSLTA |

FIG. 27 (cont'd)

| Receptor | Protein Sequence |
|---|---|
| Allergin-1 | LPKYKTRKAMRNNVPRDRGDTAMEVGIYANILEKQAKEESVPEVGSRPCVSTAQDEAKHSQELQYATPVFQEVAPREQEACDSYKSGYVYSELNF |
| Pir-B | RRRHRGKFRKDVQKEKDLQLSSGAEEPITRKGELQKRPNPAAATQEESLYASVEDMQTEDGVELNSWTPPEEDPQGETYAQVKPSRLRKAGHVSPSVMSREQLNTEYEQAEEGQGANNQAAESGESQDVTYAQLCSRTLRQGAAASPLSQAGEAPEEPSVYATLAAARPEAVPKDMEQ |
| NC-14xSAG | SAGSAGSAGSAGSAGSAGSAGSAGSAGSAGSAGSAGSAGSAG |
| TNR9_2 | KRGRKKLLYIFKQPFMRPVQTTQEEDGCSCRFPEEEEGGCEL |
| TNR9_3 | KRGRKKLLYIFKQPFMRPVQTTQEEDGCSCRFPEEEEGGCEL |
| TNR9_4 | KRGRKKLLYIFKQPFMRPVQTTQEEDGCSCRFPEEEEGGCEL |
| CD5 | KKLVKKFRQKKQRQWIGPTGMNQNMSFHRNHTATVRSHAENPTASHVDNEYSQPPRNSHLSAYPALEGALHRSSMQPDNSSDSDYDLHGAQRL |
| PECAM-1 (CD31) | KCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT |
| CEACAM-1 (CD66a) | HFGKTGRASDQRDLTEHKPSVSNHTQDHSNDPPNKMNEVTYSTLNFEAQQPTQPTSASPSLTATEIIYSEVKKQ |
| Gab2 | DVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICG |
| DOK1 | AVMEGPLFLQSQRFGTKRWRKTWAVLYPASPHGVARLEFFDHKGSSSGGGRGSSRRLDCKVIRLAECVSVAPVTVETPPEPGATAFRLDTAQRSHLLAADAPSSAAWVQTLCRNAF |
| DOK2 | GAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAF |

FIG. 28
*Streptococcus pyogenes* Cas9

```
   1 mdkkysigld igtnsvgwav itddykvpsk kfkvlgntdr hsikknliga llfdsgetae
  61 atrlkrtarr rytrrknric ylqeifsnem akvddsffhr leesflveed kkherhpifg
 121 nivdevayhe kyptiyhlrk klvdstdkad lrliylalah mikfrghfli egdlnpdnsd
 181 vdklfiqlvq tynqlfeenp inasgvdaka ilsarlsksr rlenliaqlp gekknslfgn
 241 lialsigltp nfksnfdlae daklqiskdt ydddldnila qigdqyadlf laaknlsdai
 301 llsdilrvnt eitkaplsas mikrydehhq dltilkalvr qqlpekykei ffdqskngya
 361 gyidggasqe efykfikpil ekmdgteell vklnredllr kqrtfdngsi phqihlgelh
 421 ailrrqedfy pflkdnreki ekiltfripy yvgplargns rfawmtrkse etitpwnfee
 481 vvdkgasaqs fiermtnfdk nlpnekvlpk hsllyeyftv yneltkvkyv tegmrkpafl
 541 sgeqkkaivd llfktnrkvt vkqlkedyfk kiecfdsvei sgvedrfnas lgtyhdllki
 601 ikdkdfldne enediledlv ltitlfedre mieeriktya hlfddkvmkq lkrrrytgwg
 661 rlsrklingi rdkqsgktil dflksdgfan rnfmqlihdd sltfkediqk aqvsgqgdsl
 721 hehianlags paikkgilqt vkvvdelvkv mgrhkpeniv iemarenqtt qkgqknsrer
 781 mkrieegike lgsqilkehp ventqlqnek lylyylqngr dmyvdqeldi nrlsdydvdh
 841 ivpqsflkdd sidnkvltrs dknrgksdnv pseevvkkmk nywrqllnak litqrkfdnl
 901 tkaergglse ldkagfikrq lvetrqitkh vaqildsrmn tkydendkli revkvitlks
 961 klvsdfrkdf qfykvreinn yhhahdayln avvgtalikk ypklesefvy gdykvydvrk
1021 miakseqeig katakyffys nimnffktei tlangeirkr plietngetg eivwdkgrdf
1081 atvrkvlsmp qvnivkktev qtggfskesi lpkrnsdkli arkkdwdpkk yggfdsptva
1141 ysvlvvakve kgkskklksv kellgitime rssfeknpid fleakgykev kkdliiklpk
1201 yslfelengr krmlasagel qkgnelalps kyvnflylas hyeklkgspe dneqklfve
1261 qhkhyldeii eqisefskrv iladanldkv lsaynkhrdk piregaenii hiftltnlga
1321 paafkyfdtt idrkrytstk evldatlihq sitglyetri dlsqlggd
```

FIG. 29
Nuclear receptor coactivator 1 (NCOA1; SRC1)
*Homo sapiens*

```
   1  msglgdsssd panpdshkrk gspcdtlass tekrrreqen kyleelaell sanisdidsl
  61  svkpdkckil kktvdqiqlm krmeqekstt dddvqksdis sssqgvieke slgpllleal
 121  dgfffvvnce grivfvsenv tsylgynqee lmntsvysil hvgdhaefvk nlipkslvng
 181  vpwpqeatrr nshtfncrml ihppdepgte nqeacqryev mqcftvsqpk siqedgedfq
 241  scliciarrl prppaitgve sfmtkqdttg kiisidtssl raagrtgwed lvrkciyaff
 301  qpqgrepsya rqlfqevmtr gtasspsyrf ilndgtmlsa htkcklcypq spdmqpfimg
 361  ihiidrehsg lspqddtnsg msiprvnpsv npsispahgv arsstlppsn snmvstrinr
 421  qqssdlhsss hsnssnsggs fgcspgsqiv anvalnggqa ssqssnpsln lnnspmegtg
 481  islaqfmspr rqvtsglatr prmpnnsfpp nistlsspvg mtssacnnnn rsysnipvts
 541  lqgmnegpnn svgfsasspv lrqmssqnsp srlniqpaka eskdnkeias ilnemiqsdn
 601  sssdgkplds glihnndris dgdskysqts hklvqlittt aeqqlrhadi dtsckdvlsc
 661  tgtsnsasan ssggscpssh ssiterhkil hrllqegsps dittlsvepd kkdsastsvs
 721  vtgqvgnss ikleldaskk keskdhqllr ylldkdekdl rstpnlsldd vkvkvekkeq
 781  mdpcntnptp mtkptpeeik leaqsqftad ldqfdqlipt lekaaqlpgl cetdrmdgav
 841  tsvtikseil paslqsatar ptsrlnripe leleaidnqf gqpgtgdqip wtnntvtain
 901  qsksedqcis sqldellcpp ttvegrndek alleqlvsfl sgkdetelae ldralgidkl
 961  vgggldvls erfppqqatp plimeerpnl ysqpyssspsp tanlpspfqg mvrqkpslgt
1021  mpvqvtpprg afspgmgmqp rqtlnrppaa pnqlrlqlqq rlqgqqlih qnrqailnqf
1081  aatapvginm rsgmqqqitp qpplnaqmla qrqrelysqq hrqrqliqqq ramlmrqqsf
1141  gnnlppssgl pvqmgnprlp qgapqqfpyp pnygtnpgtp pastspfsql aanpeaslan
1201  rnsmvsrgmt gniggqfgtg inpqmqqnvf qypgagmvpq geanfapsls pgssmvpmpi
1261  pppqssllqq tppasgyqsp dmkawqqgai gnnnvfsqav qnqptpaqpg vynnmsitvs
1321  maggntnvqn mnpmmaqmqm sslqmpgmnt vcpeqindpa lrhtglycnq lsstdlikte
1381  adgtqqvqqv qvfadvqctv nlvggdpyln qpgplgtqkp tsgpqtpqaq qksllqqllt
1441  e
```

FIG. 30
GRIP1 (NCOA2; TIF2; SRC2)
*Homo sapiens*

```
   1  msgmgentsd  psraetrkrk  ecpdqlgpsp  krntekrnre  qenkyieela  elifanfndi
  61  dnfnfkpdkc  ailketvkqi  rqikeqekaa  aanidevqks  dvsstggvi   dkdalgpmml
 121  ealdgfffvv  nlegnvvfvs  envtqylryn  qeelmnksvy  silhvgdhte  fvknllpksi
 181  vnggswsgep  prrnshtfnc  rmlvkplpds  eeeghdnqea  hqkyetmqcf  avsqpksike
 241  egedlqscli  cvarrvpmke  rpvlpssesf  ttrqdlqgki  tsldtstmra  amkpgwedlv
 301  rrciqkfhaq  hegesvsyak  rhhhevlrqg  lafsqiyrfs  lsdgtlvaaq  tksklirsqt
 361  tnepqlvisl  hmlhreqnvc  vmnpdltgqt  mgkplnpiss  nspahqalcs  gnpgqdmtls
 421  sninfpingp  keqmgmpmgr  fggsggmnhv  sgmqattpqg  snyalkmnsp  sqsspgmnpg
 481  qptsmlsprh  rmspgvagsp  rippsqfspa  gslhspvgvc  sstgnshsyt  nsslnalqal
 541  seghgvslgs  slaspdlkmg  nlqnspvnmn  pppIskmgsl  dskdcfglyg  epsegttgqa
 601  esschpgeqk  etndpnlppa  vsseradgqs  rlhdskgqtk  llqllttksd  qmepsplass
 661  lsdtnkdstg  slpgsgsthg  tslkekhkil  hrllqdsssp  vdlakitaea  tgkdlsqess
 721  stapgsevti  kqepvspkkk  enallrylld  kddtkdiglp  eitpklerld  sktdpasntk
 781  liamktekee  msfepgdqpg  seldnleeil  ddlqnsqlpq  lfpdtrpgap  agsvdkqaii
 841  ndlmqltaen  spvtpvgaqk  talrisqstf  nnprpgqlgr  lpnqnlpld   itlqsptgag
 901  pfppirnssp  ysvipqpgmm  gnqgmignqg  nlgnsstgmi  gnsasrptmp  sgewapqssa
 961  vrvtcaatts  amnrpvqgm   irnpaasipm  rpssqpgqrq  tlqsqvmniq  pselemmgg
1021  pqysqqapp   nqtapwpesi  lpidqasfas  qnrqpfgssp  ddllcphpaa  espsdegall
1081  dqlylalrnf  dgleeidral  gipelvsqsq  avdpeqfssq  dsnimleqka  pvfpqqyasq
1141  aqmaqgsysp  mqdpnfhtmg  qrpsyatlrm  qprpglrptg  lvqnqpnqir  lqlqhrlqaq
1201  qnrqplmnqi  snvsnvnlti  rpgvptqapi  naqmlaqrqr  eilnqhlrqr  qmhqqqvqq
1261  rtlmmrqqgl  nmtpsmvaps  gmpatmsnpr  ipqanaqqfp  fppnygisqq  pdpgftgatt
1321  pqsplmsprm  ahtqspmmqq  sqanpayqap  sdingwaqqn  mggnsmfsqq  spphfgqqan
1381  tsmysnmmni  nvsmatntgg  mssmnqmtgg  ismtsvtsvp  tsglssmgpe  qvndpalrgg
1441  nlfpnqlpgm  dmikqegdtt  rkyc
```

FIG. 31
AIB1 (NCOA3; SRC3)
*Homo sapiens*

```
   1 msglgenldp lasdsrkrkl pcdtpgglt  csgekrrreq eskyieelae lisanlsdid
  61 nfnvkpdkca ilketvrqir qikeggktis  ndddvqkadv stgggvidk  dslgplllqa
 121 ldgflfvvnr dgnivfvsen vtqylqykqe  dlvntsvyni lheedrkdfl knlpkstvng
 181 vswtnetqrq kshtfncrml mktphdiled  inaspemrqr yetmqcfals qprammeege
 241 dlqscmicva rrittgertf psnpesfitr  hdlsgkvvni dtnslrssmr pgfediirrc
 301 iqrffslndg qswsqkrhyq eaylnghaet  pvyrfsladg tivtaqtksk lfrnpvtndr
 361 hgfvsthflq reqngyrpnp npvgqgirpp  magcnssvgg msmspnqglq mpssraygla
 421 dpsttgqmsg aryggssnia sltppgpmqs  pssyqnnnyg lnmsspphgs pglapnqqni
 481 misprnrgsp kiashqfspv agvhspmass  gntgnhsfss sslsalqais egvgtslst
 541 lsspgpkldn spnmnitqps kvsnqdsksp  lgfycdqnpv essmcqsnsr dhlsdkeske
 601 ssvegaenqr gpleskghkk llqlltcssd  drghssltns pldssckess vsvtspsgvs
 661 sstsggvsst snmhgsllqe khrilhkllq  ngnspaevak itaeatgkdt ssitscgdgn
 721 vvkqeqlspk kkennallry lldrddpsda  lskelqpqve gvdnkmsqct sstipsssqe
 781 kdpkiktets eegsgdldnl dailgditss  dfynnsissn gshlgtkqqv fqgtnslglk
 841 ssqsvqsirp pynravslds pvsvgssppv  knisafpmlp kqpmlggnpr mmdsqenygs
 901 smggpnrnvt vtqtpssgdw glpnskagrm  epmnsnsmgr pggdyntslp rpalggsipt
 961 lplrsnsipg arpvlqqqqq mlqmrpgeip  mgmganpygq aaasnqlgsw pdgmlsmeqv
1021 shgtqnrpll rnslddlvgp psnleggsde  ralldqlhtl lsntdatgle eidralgipe
1081 lvnqgalep  kqdafqqgea avnmdqkagl  yggtypaggp pmqggfhlqg qspsfnsmmn
1141 qmnqqgnfpl qgmhpranim rprtntpkql  rmqlqqrlgg qqflnqsrqa lelkmenpta
1201 ggaavmrpmm qpqqgflnaq mvaqrsrell  shhfrqqrva mmmqqqqqqq qqqqqqqqqq
1261 qqqqqqqqq  qqtqafsppp nvtaspsmdg  llagptmpqa ppqqfpyqpn ygmgqqpdpa
1321 fgrvssppna mnssrmgpsq npmmqhpqaa  siyqssemkg wpsgnlarns sfsqqfahq
1381 gnpavysmvh mngssghmgg mnmnpmpmsg  mpmgpdqkyc
```

FIG. 32
PGC1a (PPARγ coactivator 1α; PPARGC1-α)
*Homo sapiens*

```
  1 mawdmcnqds esvwsdieca alvgedqplc pdlpeldlse ldvndldtds flgglkwcsd
 61 qseiisnqyn nepsnifeki deeneanlla vltetldslp vdedglpsfd altdgdvttd
121 neaspssmpd gtpppqeaee pslkklila pantqlsyne csglstqnha nhnhrirtnp
181 aivktensws nkaksicgqq kpqrrpcsel lkylttnddp phtkptenrn ssrdkctskk
241 kshtqsqsqh lqakpttlsl pltpespndp kgspfenkti ertlsvelsg tagltppttp
301 phkanqdnpf raspklkssc ktvvpppskk prysessgtq gnnstkkgpe qselyaqlsk
361 ssvltgghee rktkrpslrl fgdhdycqsi nskteilini sqelqdsrql enkdvssdwq
421 gqicsstdsd qcylretlea skqvspcstr kqlqdqeira elnkhfghps qavfddeadk
481 tgelrdsdfs neqfsklpmf insglamdgl fddsedesdk lsypwdgtqs yslfnvspsc
541 ssfnspcrds vsppkslfsq rpqrmrsrsr sfsrhrscsr spysrsrsrs pgsrsssrsc
601 yyyesshyrh rthrnsplyv rsrsrspysr rprydsyeey qherlkreey rreyekrese
661 rakqrerqrq kaieerrviy vgkirpdttr telrdrfevf geieectvnl rddgdsygfi
721 tyrytcdafa alengytlrr snetdfelyf cgrkqffksn yadldsnsdd fdpastksky
781 dsldfdsllk eaqrslrr
```

FIG. 33
PGC1b (PPARγ coactivator 1β; PERC)
*Homo sapiens*

```
   1 magndcgall deelssffln yladtqgggs geeqlyadfp eldlsqldas dfdsatcfge
  61 lqwcpenset epnqyspdds elfqidsene allaeltktl ddipeddvgl aafpaldggd
 121 alsctsaspa pssappspap ekpsapapev delsliqkll latsyptsss dtqkegtawr
 181 qaglrsksqr pcvkadstqd kkapmmqsqs rsctelhkhl tsaqcclqdr glqppclqsp
 241 ripakedkep gedcpspqpa pasprdslal gradpgapvs qedmqamvql irymhtyclp
 301 qrklppqtpe plpkacsnps qqvrsrpwsr hhskaswaef silrellaqd vlcdvskpyr
 361 latpvyaslt prsrprppkd sqaspgrpss veevriaasp kstgprpslr plrlevkrev
 421 rrparlqqe eedeeeeee eeeekeeeee wgrkrpgrgl pwtklgrkle ssvcpvrrsr
 481 rlnpelgpwl tfadeplvps epqgalpslc lapkaydver elgsptdeds gqdqqllrgp
 541 qipalespce sgcgdmdedp scpqlpprds prclmlalsq sdptfgkksf eqtltvelcg
 601 tagltppttp pykpteedpf kpdikhslgk eialslpspe glslkatpga ahklpkkhpe
 661 rsellshlrh ataqpasqag qkrpfscsfg dhdycqvlrp egvlqrkvlr swepsgvhle
 721 dwpqggapwa eaqapgreed rscdagappk dstllrdhei rasltkhfgl letaleeedl
 781 asckspeydt vfedsssssg essflpeeee eegeeeeedd eeedsgvspt csdhcpyqsp
 841 pskanrqlcs rsrsssgssp chswspatrr nfrcesrgpc sdrtpslrha rkrrekalge
 901 grvvyiqnls sdmssrelkr rfevfgelee cevltrnrrg ekygfityrc sehaalsltk
 961 gaalrkrnep sfqlsygglr hfcwprytdy dsnseealpa sgkskyeamd fdsllkeaqq
1021 slh
```

FIG. 34
PRC (peroxisome proliferator-activated receptor gamma coactivator-related protein 1)

```
   1 maarrgrrdg vapppsggpg pdpgggargs gwgsrsqapy gtlgavsgge qvllheeagd
  61 sgfvslsrlg pslrdkdlem eelmlqdetl lgtmqsymda slisliedfg slgesrlsle
 121 dqnevslita lteildnads enlspfdsip dsellvspre gsslhklltl srtpperdli
 181 tpvdplgpst gssrgsgvem slpdpswdfs ppsfletssp klpswrpprs rprwgqsppp
 241 qqrsdgeeee evasfsgqil ageldncvss ipdfpmhlac peeedkataa emavpaagde
 301 sisslselvr amhpycipnl thlasledel qeqpddltip egcvvleivg qaatagddle
 361 ipvvvrqvsp gprpvlldds letssalqll mptlesetea avpkvtlcse keglslnsee
 421 kldsaclikp revvepvvpk epqnppanaa pgsqrarkgr kkkskeqpaa cvegyarrlr
 481 sssrgqstvg tevtsqvdnl qkqpqeelqk esgplqgkgk prawarawaa alensspknl
 541 ersagqsspa kegpldlypk ladtiqtnpi pthlslvdsa qaspmpvdsv eadptavgpv
 601 lagpvpvdpg lvdlastsse lvepipaepv linpvladsa avdpavvpis dnlppvdavp
 661 sgpapvdlal vdpvpndltp vdpvlvksrp tdprrgavss alggsapqll veseslddppk
 721 tiipevkevv dslkiesgts atthearprp lslseyrrrr qqrqaeteer spqpptgkwp
 781 slpetptgla dipclvippa pakktalqrs petpleiclv pvqpspasps peppvskpva
 841 sspteqvpsq emplarpsp pvqsvspavp tppsmsaalp fpagglgmpp slpppplqpp
 901 slplsmgpvl pdpfthyapl pswpcyphvs psgypclppp ptvplvsgtp gayavpptcs
 961 vpwapppapv spysstctyg plgwgpgpqh apfwstvppp plppasigra vpqpkmesrg
1021 tpagppenvl plsmappisl glpghgapqt eptkvevkpv pasphpkhkv salvqspqmk
1081 alacvsaegv tveepaserl kpetqetrpr ekpplpatka vptprqstvp klpavhparl
1141 rklsflptpr tggsedvvqa fiseigieas disslleqfe kseakkecpp papadslavg
1201 nsggvdipqe krpldrlqap elanvagltp patpphqlwk plaavsllak akspkstaqe
1261 gtikpegvte akhpaavrlq egvhgpsrvh vgsgdhdycv rsrtppkkmp alvipevgsr
1321 wnvkrhqdit ikpvlslgpa appppciaas repldhrtss eqadpsapcl apssllspea
1381 spcrndmntr tppepsakqr smrcyrkacr saspssgqwq grrgrnsrsv ssgsnrtsea
1441 ssssssssss srsrsrslsp phkrwrrssc sssgrsrrcs sssssssssss sssssssssr
1501 srsrspsprr rsdrrrryss yrshdhyqrq rvlqkeraie errvvfigki pgrmtrselk
1561 qrfsvfgeie ectihfrvgg dnygfvtyry aeeafaaies ghklrqadeq pfdlcfggrr
1621 qfckrsysdl dsnredfdpa pvkskfdsld fdtllkqaqk nlrr
```

FIG. 35
TRAP220 (TRIP-2; PPARGBP; PBP)
*Homo sapiens*

```
   1  mkaqgetees eklskmssll erlhakfnqn rpwsetiklv rqvmekrvvm ssgghqhlvs
  61  cletlqkalk vtslpamtdr lesiarqngl gshlsasgte cyitsdmfyv evqldpaggl
 121  cdvkvahge npvscpelvq qlreknfdef skhlkglvnl ynlpgdnklk tkmylalqsl
 181  eqdlskmaim ywkatnagpl dkilhgsvgy ltprsgghlm nlkyyvspsd llddktaspi
 241  ilhennvsrs lgmnasvtie gtsavyklpi aplimgshpv dnkwtpsfss itsansvdlp
 301  acfflkfpqp ipvsrafvqk lqnctgiplf etqptyaply elitqfelsk dpdpiplnhn
 361  mrfyaalpgq qhcyflnkda plpdgrslqg tlvskitfqh pgrvplilnl irhqvayntl
 421  igscvkrtil kedspgllqf evcplsesrf svsfqhpvnd slvcvvmdvq dsthvsckly
 481  kglsdalict ddfiakvvqr cmsipvtmra irrkaetiqa dtpalsliae tvedmvkknl
 541  ppasspgygm ttgnnpmsgt ttptntfpgg pittlfnmsm sikdrhesvg hgedfskvsq
 601  npiltsliqi tgnggstigs sptpphhtpp pvssmagntk nhpmlmnllk dnpaqdfstl
 661  ygssplerqn sssgsprmei csgsnktkkk kssrlppekp khqteddfqr elfsmdvdsq
 721  npifdvnmta dtldtphitp apsqcstppt typqpvphpq psiqrmvrls ssdsigpdvt
 781  dilsdiaeea sklpstsddc paigtplrds ssghsqstl fdsdvfqtnn nenpytdpad
 841  liadaagsps sdsptnhffh dgvdfnpdll nsqsqsgfge eyfdessqsg dnddfkgfas
 901  qalntlgvpm lggdngetkf kgnnqadtvd fsiisvagka lapadlmehh sgsqgplltt
 961  gdlgkektqk rvkegngtsn stlsgpglds kpgkrsrtps ndgkskdkpp krkkadtegk
1021  spshsssnrp ftpptstggs kspgsagrsq tppgvatppi pkitiqipkg tvmvgkpssh
1081  sqytssgsvs ssgskshhsh ssssssast sgkmksskse gssssklsss myssqgssgs
1141  sqsknssqsg gkpgsspitk hglssgssst kmkpggkpss lmnpslskpn ispshsrppg
1201  gsdklaspmk pvpgtppssk akspisssgsg gshmsgtsss sgmksssglg ssgslsqktp
1261  pssnsctass ssfsssgssm sssqnqhgss kgkspsrnkk psltavidkl khgvtsgpg
1321  gedpldgqmg vstnssshpm sskhnmsgge fqgkreksdk dkskvstsgs svdsskktse
1381  sknvgstgva kiiiskhdgg spsikakvtl qkpgessgeg lrpqmasskn ygsplisgst
1441  pkhergspsh skspaytpqn ldsesesgss iaeksyqnsp ssddgirplp eystekhkkh
1501  kkekkkvkdk drdrdrkdr dkkkshsikp eswskspiss dqslsmtsnt ilsadrpsrl
1561  spdfmigeed ddlmdvalig n
```

FIG. 36A
ASC2 (NCOA6; RAP250; PRIP; AIB3; NRC)
*Homo sapiens*

```
   1  mvlddlpnle diytslcsst medsemdfds gleddtksd siledstifv afkgniddkd
  61  fkwkldailk nvpnllhmes sklkvqkvep wnsvrvtfni preaaerlri laqsnnqqlr
 121  digilsvqie gegainlala qnrsqdvrmn gpmgagnsvr meagfpmasg pgiirmnnpa
 181  tvmippggnv sssmmapgpn pelqprtprp asqsdamdpl lsglhiqqqs hpsgslapph
 241  hpmqpvsvnr qmnpanfpql qqqqqqqqqq qqqqqlqarp qqqqqlqarp pqqhqqqqpq
 301  girpqftapt qvpvppgwnq lpsgalqppp aggslgtmta ngwkkaplp gpmqqqlqar
 361  pslatvqtps hppppypfgs qqasqahtnf pqmsnpgqft apqmkslqgg psrvptplqq
 421  phltnkspas spssfqqgsp assptvnqtq qqmgprppqn nplpqgfqqp vsspgrnpmv
 481  qqgnvppnfm vmqqappnqg pqslhpglgg mpkrlppgfs agqanpnfmq gqvpsttatt
 541  pgnsgapqlq anqnvqhagg qgagppqnqm qvshgppnmm qpslmgihgn mnnqqagtsg
 601  vpqvnlsnmq gqpqggppsq lmgmhqqivp sqgqmvqqqg tlnpqnpmil sraqlmpqgq
 661  mmvnppsqnl gpspqrmtpp kqmlsqqgpq mmaphnqmmg pqgqvllqqn pmieqimtnq
 721  mqgnkqqfnt qnqsnvmpgp aqimrgptpn mqgnmvqftg qmsgqmlpqq gpvnnspsqv
 781  mgiqgqvlrp pqpsphmaqq hgdpattann dvslsqmmpd vsiqqtnmvp phvqamqgns
 841  asgnhfsghg msfnapfsga pngnqmscgq npgfpvnkdv tltspllvnl lqsdisaghf
 901  gvnnkqnntn ankpkkkkpp rkkknsqqdl ntpdtrpagl eeadqpplpg egginldnsg
 961  pklpefsnrp pgypsqpveq rplqmppql mqhvapppqp pqqpqpqlp qqqppppsq
1021  pqsqqqqqq qqmmmmlmmq qdpksvrlpv sqnvhpprgp lnpdsqrmpm qqsgsvpvmv
1081  slqgpasvpp spdkqrmpmp vntplgsnsr kmvyqespqn pssplaema slpeasgsea
1141  psvpggpnnm pshvvlpqng lmmtgpkpgp splsatqgat pqqppvnslp sshghhfpnv
1201  aaptqtsrpk tpnrasprpy ypqtpnnrpp stepseisls perlnasiag lfppqinipl
1261  pprpnlnrgf dqgglnpttl kaigqapsnl tmnpsnfatp qthkldsvvv nsgkqsnsga
1321  tkraspsnsr rsspgssrkt tpspgrqnsk apkitlasqt naallqnvel prnvlvsptp
1381  lanppvpgsf pnnsglnpqn stvsvaavgg vvednkesln vpqdsdcqns qsrkeqvnie
1441  lkavpaqevk mvvpedqskk dgqpsdpnkl psveenknlv spamreapts lsqlldnsga
1501  pnvtikppgl tdlevtppvv sgedlkkasv iptlqdlsss kepsnslnlp hsnelcsslv
1561  hpelsevssn vapsippvms rpvssssist plppnqitvf vtsnpittsa ntsaalpthl
1621  qsalmstvvt mpnagskvmv seggsaaqsn arpqfitpvf inssslqvm kgsqpstipa
1681  aplttnsglm ppsvavvgpl hipqnikfss apvppnalss spapniqtgr plvlssratp
```

FIG. 36B

```
1741 vqlpsppcts spvvpshppv qqvkelnpde aspqvntsad qntlpssqst tmvsplitns
1801 pgssgnrrsp vssskgkgkv dkigqilltk ackkvtgsle kgeeqygadg eteggldtt
1861 apglmgteql steldsktpt ppaptlikmt sspvgpgtas agpslpggal ptsvrsivtt
1921 lvpselisav pttksnhggi aseslagglv eekvgshpel lpsiapsqnl vsketsttal
1981 qasvarpele vnaaivsgqs sepkeiveks kipgrrnsrt eeptvasesv enghrkrssr
2041 pasassstkd itsavgskrr ksk
```

FIG. 37A
CBP (RSTS; KAT3A)
*Homo sapiens*

```
   1  maenlldgpp  npkraklssp  gfsandstdf  gslfdlendl  pdelipngge  lgllnsgnlv
  61  pdaaskhkql  sellrggsgs  sinpgignvs  asspvqgglg  gqaggqpnsa  nmaslsamgk
 121  splsqgdssa  pslpkqaast  sgptpaasqa  lnpqaqkqvg  latsspatsq  tgpgicmnan
 181  fnqthpglln  snsghsling  asqgqaqvmn  gslgaagrgr  gagmpyptpa  mqgasssvla
 241  etltqvspqm  tghaglntaq  aggmakmgit  gntspfgqpf  sqaggqpmga  tgvnpqlask
 301  qsmvnslptf  ptdikntsvt  nvpnmsqmqt  svgivptqai  atgptadpek  rkliqqqlvl
 361  llhahkcqrr  eqangevrac  slphcrtmkn  vlnhmthcqa  gkacqvahca  ssrqiishwk
 421  nctrhdcpvc  lplknasdkr  nqqtilgspa  sgiqntigsv  gtgqnatsl  snpnpidpss
 481  mqrayaalgl  pymnqpqtql  qpqvpgqqpa  sgiqntigsv  lnplgnnpmn  ipaggittdq
 541  qppnlisesa  lptslgatnp  lmndgsnsgn  qpqthqqmrt  appsstgvrk  gwhehvtqdl
 601  rshlvhklvq  aifptpdpaa  lkdrrmenlv  igtlstipta  yesansrdey  yhllaekiyk
 661  iqkeleekrr  srlhkqgilg  nqpalpapga  ayakkvegdm  vrppngplsl  pvnrmqvsgg
 721  mnsfnpmslg  nvqlpqapmg  praaspmnhs  qppvipqaqp  gmaispsrmp  qppnmmgaht
 781  nnmmaqapaq  sqflpqnqfp  sssgamsvgm  vqmnsmgsvp  qggvpgaalp  nplnmlgpqa
 841  sqlpcppvtq  spihptpppa  staagmpslq  gqppaqtgvs  qpaaptqpst  pvsssgqtpt
 901  ptpgsvpsat  qtqstptvqa  aaqaqvtpqp  httppgmtpp  tpqssqqpt  pvhaqppgtp
 961  lsqaaasidn  rvptpssvas  aetnsqqpgp  qtpvqppsva  tqaedtepdp  geskgeprse
1021  mmeediqgas  qvkeetdiae  qksepmevde  dvpvlemkte  eeeesssngt  asqstspsqp
1081  rkkifkpeel  rqalmptlea  lyrqdpeslp  kkpevkvevk  gipdyfdivk  npmdlstikr
1141  kldtgqyqep  wqyvddvwlm  fnnawlynrk  frqpvdpqll  laevfeqeid  pvmqslgycc
1201  grkyefspqt  lccygkqlct  iprdaayysy  tsrvykfcsk  fteiqgenvt  lgddpsqpqt
1261  tiskdqfekk  kndtldpepf  vdckecgrkm  qnryhfcekc  iwpsgfvcdn  clkktgrprk
1321  enkfsakrlq  ttrlgnhled  rvnkflrrqn  hqicvlhydi  vvassdktve  vkpgmksrfv
1381  dsgemsesfp  yrtkalfafe  eidgvdvcff  hpeagevfvr  cpppntrrvy  isyldsihff
1441  rprclrtavy  heiligyley  vkklgyvtgh  gmhvqeygsd  dyifhchppd  qkipkpkrlq
1501  ewykkmldka  faeriihdyk  difkqatedr  iwacppsegd  srankkkpsm  esikeleqee
1561  eerkkeesta  asettegsqg  dsknakkknn  ltsakelpyf  mdgrdafltl  pnvsndlsqk
1621  lyatmekhke  vffvihlhag  pvintlppiv  kktknknkssi  tvceedydlci  ardkhwefss
1681  lrrskwstlc  mlvelhtqgq  drfvytcnec  dpdplscdl  hacqcrnanc  ncyntkshah
1741  kmvkwglgld  degssqgepq  skspqesrrl  khhvetrwhc  siqrciqslv  slpscqkmkr
```

FIG. 37B

```
1801 vvqhtkgckr ktnggcpvck qlialccyha khcqenkcpv pfclnikhkl rqqqiqhrlq
1861 qaqlmrrma tmntrnvpqq slpsptsapp gtptqqpstp qtpqppaqpq pspvsmspag
1921 fpsvartqpp ttvstgkpts qvpapppaq pppaaveaar qiereaqqqq hlyrvninns
1981 mppgrtgmgt pgsqmapvsl nvprpnqvsg pvmpsmppgq wqqaplpqqq pmpglprpvi
2041 smqaqaavag prmpsvqppr sispsalqdl lrtlkspssp qqqqvlnil ksnpqlmaaf
2101 ikqrtakyva nqpgmqpqpg lqsqpgmqpq pgmhqqpslq nlnamqagvp rpgvppqqqa
2161 mgglnpqqqa lnimnpghnp nmasmnpqyr emlrrqllqq qqqqqqqqqq qqqqqqgsag
2221 maggmaghgq fqqpqgpggy ppamqqqrm qqhlplqgss mgqmaaqmgq lgqmgqpglg
2281 adstpniqqa lqqrilqqqq mkqqigspgq pnpmspqqhm lsgqpqashl pgqqiatsls
2341 nqvrspapvq sprpqsqpph sspspriqpq psphhvspqt gsphpglavt massidqghl
2401 gnpeqsamlp qlntpsrsal sselslvgdt tgdtlekfve gl
```

FIG. 38A
P300 (KAT3B; RSTS2)
*Homo sapiens*

```
   1 maenvvepgp psakrpklss palsasasdg tdfgslfdle hdlpdelins telgltnggd
  61 inqlqtslgm vqdaaskhkq lsellrsgss pnlnmgvggp gqvmasqaqq sspgiglins
 121 mvkspmtqag ltspnmgmgt sgpnggptqs tgmmnspvnq pamgmntgmn agmnpgmlaa
 181 gnqgimpnq vmngsigagr grqnmqypnp gmgsagnllt eplqqgspqm ggqtglrgpq
 241 plkmgmmnnp npygspytqn pqgqigasgl glqiqtktvl snnlspfamd kkavpggmp
 301 nmgqqpapqv qqpglvtpva qgmgsgahta dpekrkliqq qlvlllhahk cqrreqange
 361 vrqcnlphcr tmknvlnhmt hcqsgkscqv ahcassrqii shwknctrhd cpvclplkna
 421 gdkrnqqpil tgapvglgnp sslgvgqqsa pnlstvsqid pssierayaa lglpyqvnqm
 481 ptqpqvqakn qqnqapgqsp qgmrpmsnms aspmgvnggv gvqtpsllsd smhsainsq
 541 npmmsenasv pslgpmptaa qpsttgirkq wheditqdlr nhlvhklvqa ifptpdpaal
 601 kdrrmenlva yarkvegdmy esannraeyy hllaekiyki qkeleekrrt rlqkqnmlpn
 661 aagmvpvsmn pgpnmgqpqp gmtsngplpd psmirgsvpn qmmpritpqs glnqfgqmsm
 721 aqppivprqt pplqhhgqla qpgalnppmg ygprmqqpsn qgqflpqtqf psqgmnvtni
 781 plapssgqap vsqaqmssss cpvnspimpp gsqgshihcp qlpqpalhqn spspvpsrtp
 841 tphhtppsig aqqppattip apvptppamp pgpqsqalhp pprqtptppt tqlpqqvqps
 901 lpaapsadqp qqqprsqqst aasvptptap lppqpatpl sqpavsiegq vsnppstsst
 961 evnsqaiaek qpsqevkmea kmevdqpepa dtqpedises kvedckmest eteerstelk
1021 teikeeedqp stsatqsspa pgqskkkifk peelrqalmp tlealyrqdp eslpfrqpvd
1081 pqlgipdyf divkspmdls tikrkldtgg yqepwqyvdd iwlmfnnawl ynrktsrvyk
1141 ycsklsevfe qeidpvmqsl gyccgrklef spqtlccygk qlctiprdat yysyqnryhf
1201 cekcfneiqg esvslgddps qpqttinkeq fskrkndtld pelfvectec grkmhqicvl
1261 hheiiwpagf vcdgclkksa rtrkenkfsa kripstrigt flenrvndfl rrqnhpesge
1321 vtvrvvhasd ktvevkpgmk arfvdsgema esfpyrtkal fafeeidgvd lcffqmhvqe
1381 ygsdcpppnq rrvyisylds vhffrpkclr tavyheilig yleyvkklgy ttghiwacpp
1441 segddyifhc hppdqkipkp krlgewykkm ldkavseriv hdykdifkqa tedrltsake
1501 lpyfegdfwp nvleesikel eqeeeerkre entsnestdv tkgdsknakk knnkktsknk
1561 sslsrgnkkk pgmpnvsndl sqklyatmek hkevffvirl iagpaanslp pivdpdplip
1621 cdlmdgrdaf ltlardkhle fsslrraqws tmcmlvelht qsqdrfvytc neckhhvetr
1681 whctvcedyd lcitcyntkn hdhkmekigl glddesnnqq aaatqspgds rrlsiqrciq
```

FIG. 38B

```
1741 slvhacqcrn ancslpscqk mkrvvqhtkg ckrktnggcp ickqlialcc yhakhcqenk
1801 cpvpfclnik qklrqqlqh rlqqaqmlrr rmasmqrtgv vgqqglpsp tpatpttptg
1861 qqpttpqtpq ptsqpqptpp nsmppylprt qaagpvsqgk aagqvtpptp pqtaqpplpg
1921 pppaavemam qiqraaetqr qmahvqifqr piqhqmppmt pmapmgmnpp pmtrgpsghl
1981 epgmgptgmq qppwsqggl pqpqqlqsgm prpammsvaq hgqplnmapq pglgqvgisp
2041 lkpgtvsqga lqnlirtlrs pssplqqqqv lsilhanpql laafikqraa kyansnpqpi
2101 pgqpgmpqgq pglqpptmpg qqgvhsnpam qnmnpmqagv qraglpqqqp qqqlqppmgg
2161 mspqaqqmnm nhntmpsqfr dilrrqqmmq qqqqgagpg igpgmanhnq fqqpggvgyp
2221 pqqqrmqhh mqqmqqgnmg qigqlpqalg aeagaslqay qqrllqqqmg spvqpnpmsp
2281 qqhmlpnqaq sphlqgqqip nslsnqvrsp qpvpsprpqs qpphssspspr mqpqpsphhv
2341 spqtssphpg lvaaqanpme qqhfaspdqn smlsqlasnp gmanlhgasa tdlglstdns
2401 dlnsnlsqst ldih
```

FIG. 39
CIA (NCOA5;
*Homo sapiens*

```
  1 mntapsrpsp trrdpygfgd srdsrrdrsp irgsprrepr dgrngrdard srdirdprdl
 61 rdhrhsrdlr dhrdsrsvrd vrdvrdlrdf rdlrdsrdfr dqrdpmydry rdmrdsrdpm
121 yrregsydry lrmddycrrk ddsyfdryrd sfdgrgppgp esqsrakerl kreerreel
181 yrqyfeeiqr rfdaerpvdc svivvnkqtk dyaesvgrkv rdlgmvvdli flntevslsq
241 aledvsrggs pfaivitqqh qihrsctvni mfgtpqehrn mpqadamvlv arnyerykne
301 crekereeia rqaakmadea ilqererggp eegvrgghpp aiqslinlla dnryltaeet
361 dkiinylrer kerlmrsstd slpgpisrqp lgatsgasik tpssqplqs gqvlpsatpt
421 psapptsqqe lqakilslfn sgtvtansss aspsvaagnt pnqnfistaan sqpqqrsqas
481 gnqppsilgq ggsaqnmgpr pgapsqglfg qpssrlapas nmtsqrpvss tginfdnpsv
541 qkaldtliqs gpalshlvsq ttaqmgqpqa pmgsyqrhy
```

FIG. 40
ARA70 (NCOA4; PTC3; RFG; ELE1)
*Homo sapiens*

```
  1 mntfqdqsgs ssnrepllrc sdarrdiela iggvlraeqq ikdnlrevka qihscisrhl
 61 eclrsrevwl yeqvdliyql keetlqqqaq qlysligqfn clthqlectq nkdlanqvsv
121 clerlgsltl kpedstvllf eadtitlrqt ittfgslkti qipehlmaha ssanigpfle
181 krgcismpeq ksasgivavp fsewlligskp asgyqapyip stdpqdwltq kqtlensqts
241 sracnffnnv ggnlkglenw llkseksssyq kcnshsttss fsiemekvgd qelpdqdemd
301 lsdwlvtpqe shklrkpeng sretsekfkl lfqsynvndw lvktdsctnc qgnqpkgvei
361 enlgnlkcln dhleakkpls tpsmvtedwl vqnhqdpckv eevcranepc tsfaecvcde
421 ncekealykw llkkegkdkn gmpvepkpep ekhkdslnmw lcprkevieq tkapkamtps
481 riadsfqvik nsplsewlir ppykegspke vpgtedragk qkfkspmnts wcsfntadwv
541 lpgkkmgnls qlssgedkwl lrkkaqevll nsplqeehnf ppdhyglpav cdlfacmqlk
601 vdkekwlyrt plqm
```

FIG. 41
TIF1 (RNF82; PTC6; HTIF1)
*Homo sapiens*

```
  1 mevavekava aaaaasaaas ggpsaapsge neaesrqgpd serggeaarl nlldtcavch
 61 qniqsrapkl lpclhsfcqr clpapqrylm lpapmigsae tpppvpapgs pvsgsspfat
121 qvgvircpvc sqecaerhii dnffvkdtte vpsstveksn qvctscedna eangfcvecv
181 ewlcktcira hqrvkftkdh tvrqkeevsp eavgvtsqrp vfcpfhkkeq lklycetcdk
241 ltcrdcqlle hkehryqfie eafqnqkvii dtlitklmek tkyikftgnq iqnriievnq
301 nqkqveqdik vaiftlmvei nkkgkallhq leslakdhrm klmqqqeva giskqlehvm
361 hfskwavssg sstallyskr lityrlrhll rarcdaspvt nntiqfhcdp sfwaqniinl
421 gslviedkes qpqmpkqnpv veqnsqppsg lssnqlskfp tqislaqlrl qhmqqqppp
481 rlinfqnhsp kpngpvlpph pqqlryppnq niprqaikpn plqmaflaqq aikqwqissg
541 qgtpsttnst sstpssptit saagydgkaf gspmidlssp vggsynlpsl pdidcsstim
601 ldnivrkdtn idhgqprpps nrtvqspnss vpspglagpv tmtsvhppir spsassvgsr
661 gssgssskpa gadsthkvpv vmlepirikq ensgppenyd fpvvivkqes deesrpqnan
721 yprsiltsll lnssqsstse etvlrsdapd stgdqpglhq dnssngksew ldpsqkspih
781 vgetrkeddp nedwcavcqn ggellccekc pkvfhlschv ptltnfpsge wictfcrdls
841 kpeveydcda pshnsekkkt eglvkltpid krkcerlllf lychemslaf qdpvpltvpd
901 yykiiknpmd lstikkrlqe dysmyskped fvadfrlifq ncaefnepds evanagikle
961 nyfeellknl ypekrfpkpe frnesednkf sddsdddfvq prkkrlksie erqllk
```

FIG. 42A
NSD1 (ARA267; SOTOS1; KMT3B)
*Homo sapiens*

```
   1 mdqtcelprr ncllpfsnpv nldapedkds pfgngqsnfs eplngctmql stvsgtsqna
  61 yggdspscyi plrrlqdlas minveylngs adgsesfqdp eksdsraqtp ivctslspgg
 121 ptalamkqep scnnspelqv kvtktikngf lhfenftcvd dadvdsemdp eqpvtedesi
 181 eeifeetqtn atcnyetkse ngvkvamgse qdstpesrhg avkspflpla pqtetqknkq
 241 rnevdgsnek aallpapfsl gdtnitieeq lnsinlsfqd dpdsststlg nmlelpgtss
 301 sstsqelpfc qpkkkstplk yevgdliwak fkrrpwwpcr icsdplinth skmkvsnrrp
 361 yrqyyveafg dpserawvag kaivmfegrh qfeelpvlrr rgkqkekgyr hkvpqkilsk
 421 weasvglaeq ydvpkgsknr kcipgsikld seedmpfedc tndpesehdl llngciksla
 481 fdsehsadek ekpcaksrar kssdnpkrts vkkghiqfea hkderrgkip enlglnfisg
 541 disdtqasne lsrianslt g sntapgsflf sscgkntakk efetsngdsl lglpegalis
 601 kcsreknkpq rslvcgskvk lcyigagdee krsdsisict tsddgssdid piehssesdn
 661 svleipdafd rtenmlsmqk nekikysrfa atntrvkakq kplisnshtd hlmgctksae
 721 pgtetsqvnl sdlkastlvh kpqsdftnda lspkfnlsss issenslikg gaanqallhs
 781 kskqpkfrsi kckhkenpvm aeppvineec slkccssdtk gsplasisks gkvdgiklln
 841 nmhektrdss dietavvkhv lselkelsyr slgedvsdsg tskpskpllf ssassqnhip
 901 iepdykfstl lmmlkdmhds ktkeqrlmta qnlvsyrspg rgdcstnspv gvskvlvsgg
 961 sthnsekkgd gtqnsanpsp sggdsalsge lsasipglls dkrdlpasgk srsdcvtrrn
1021 cgrskpsskl rdafsaqmvk ntvnrkalkt erkrkinqlp svtldavlqg drerggslrg
1081 gaedpskedp lqimghltse dgdhfsdvhf dskvkqsdpg kisekglsfe ngkgpeldsv
1141 mnsendelng vnqvvpkkrw qrlnqrrtkp rkrmnrfkek ensecafrvl lpsdpvqegr
1201 defpehrtps asileeplte qnhadcldsa gprlnvcdks sasigdmeke pgipsltpqa
1261 elpepavrse kkrlrkpskw lleyteeydq ifapkkkqkk vqeqvhkvss rceeesllar
1321 grssaqnkqv denslistke eppvlereap fleplaqse lggghaelpq itlsvpvape
1381 vsprpalese ellvktpgny eskrqrkptk kllesndldp gfmpkkgdlg lskkcyeagh
1441 lengitesca tsyskdfggg ttkifdkprk rkrqrhaaak mqckkvkndd sskeipgseg
1501 elmphrtats pketveegve hdpgmpaskk mqgergggaa lkenvcqnce klgelllcea
1561 qccgafhlec lgltemprgk ficnecrtgi htcfvckqsg edvkrcllpl cgkfyheecv
1621 qkypptvmqn kgfrcslhic itchaanpan vsaskgrlmr cvrcpvayha ndfclaagsk
1681 ilasnsiicp nhftprrgcr nhehvnvswc fvcseggsll ccdscpaafh reclnidipe
```

FIG. 42B

```
1741 gnwycndcka gkkphyreiv wvkvgryrww paeichprav psnidkmrhd vgefpvlffg
1801 sndylwthqa rvfpymegdv sskdkmgkgv dgtykkalqe aaarfeelka qkelrqlqed
1861 rkndkkpppy khikvnrpig rvqiftadls eiprcnckat denpcgidse cinrmllyec
1921 hptvcpaggr cqnqcfskrq ypeveifrtl qrgwglrtkt dikkgefvne yvgelideee
1981 crariryaqe hditnfymlt ldkdriidag pkgnyarfmn hccqpncetq kwsvngdtrv
2041 glfalsdika gteltfnynl eclgngktvc kcgapncsgf lgvrpknqpi ateekskkfk
2101 kkqqgkrrtq geitkerede cfscgdaggl vsckkpgcpk vyhadclnlt krpagkwecp
2161 whqcdicgke aasfcemcps sfckqhregm lfiskldgrl sctehdpcgp nplepgeire
2221 yvpppvplpp gpsthlaeqs tgmaaqapkm sdkppadtnq mlskkala gtcqrplpe
2281 rplertdsrp qpldkvrdla gsgtksqslv ssqrpldrpp avagprpqls dkpspvtsps
2341 sspsvrsqpl erplgtadpr ldksigaasp rpqslektsv ptglrlpppd rllitsspkp
2401 qtsdrptdkp haslsqrlpp pekvlsavvq tlvakekalr pvdqntqskn raalvmdlid
2461 ltprqkeraa sphqvtpqad ekmpvlesss wpaskglghm pravekgcvs dplqtsgkaa
2521 apsedpwqav ksltqarlls qppakaflye pttqasgras agaeqtpgpl sqspglvkqa
2581 kqmvgggqlp alaaksgqsf rslgkapasl pteekklvtt eqspwalgka ssraglwpiv
2641 agqtlaqscw sagstqtlaq tcwslgrgqd pkpeqntlpa lnqapsshkc aeseqk
```

FIG. 43
SMAP
*Homo sapiens*

```
  1 matgtgkhkl lstgptepws ireklclass vmrsgdqnwv svsraikpfa epgrppdwfs
 61 qkhcasqyse llettetpkr krgekgevve tvedvivrkl taerveelkk viketqeryr
121 rlkrdaeliq aghmdsrlde lcndiatkkk leeeeaevkr katdaaygar qavktpprrl
181 ptvmvrspid saspggdypl gdltpttmee atsgvtpgtl pstpvtsfpg ipdtlppgsa
241 pleapmtpvt ddspqkkmlg qkatpppspl lselkkgsl lptsprlvne semavasghl
301 nstgvllevg gvlpmihgge iqqtpntvaa spaasgaptl srlleagptq fttplasftt
361 vaseppvklv pppvesvsqa tivmmpalpa pssapavstt esvapvsqpd ncvpmeavgd
421 phtvtvsmds seismiinsi keecfrsgva eapvgskaps idgkeeldla ekmdiavsyt
481 geeldfetvg diiailiedkv ddhpevldva aveaalsfce enddpqslpg pwehpiqqer
541 dkpvplpape mtvkqerldf eetenkgihe lvdirepsae ikvepaepep visgaeivag
601 vvpatsmepp elrsqdldee lgstaageiv eadvaigkgd etpltnvkte aspesmlsps
661 hgsnpiedpl eaetqhkfem sdslkeesgt ifgsqikdap gedeeedgvs eaasleepke
721 edgegeylse mdneppvses ddgfsihnat lqshtladsi psspassqfs vcsedqeaiq
781 aqkiwkkaim lwraaanhr yanvflqpvt ddiapgyhsi vqrpmdlsti kknienglir
841 staefqrdim lmfqnavmyn ssdhdvyhma vemqrdvleq iqqflatqli mqtsesgisa
901 kslrgrdstr kqdasekdsv pmgspaflls lfdggtrgrr caieadmkmk k
```

FIG. 44
Tip60 (HTATIP; ESA1; PLIP; Tat ineracting protein; CPLA2)
*Homo sapiens*

```
  1 maevgeiieg crlpvlrrnq dnedewplae ilsvkdisgr klfyvhyidf nkrldewvth
 61 erldlkkiqf pkkeaktptk nglpgsrpgs perevpasaq asgktlpipv qitlrfnlpk
121 ereaipggep dqplsssscl qpnhrstkrk vevvspatpv psetapasvf pqngaarrav
181 aaqpgrkrks nclgtdedsq dssdgipsap rmtgslvsdr shddivtrmk niecielgrh
241 rlkpwyfspy pqelttlpvl ylcefclkyg rslkclqrhl tkcdlrhppg neiyrkgtis
301 ffeidgrknk sysqnlclla kcfldhktly ydtdpflfyv mteydckgfh ivgyfskeke
361 stedynvaci ltlppyqrrg ygklliefsy elskvegktg tpekplsdlg llsyrsywsq
421 tileilmglk sesgerpqit ineiseitsi kkedvistlq ylnlinyykg qyiltlsedi
481 vdgheramlk rllridskcl hftpkdwskr gkw
```

FIG. 45
ERAP140 (NCOA7)
*Homo sapiens*

```
  1 mdtkeekker kqsyfarlkk kkgakqnaet asavatrtht gkednntvvl epdkcniave
 61 eeymtdekkk rksnqlkeir rtelkryysi ddnqnkthdk kekkmvvqkp hgtmeytagn
121 qdtlnsialk fnitpnklve lnklfthtiv pggvlfvpda nspsstlrls ssspgatvsp
181 sssdaeydkl pdadlarkal kpiervlsst seedepgvvk flkmncryft dgkgvvggvm
241 ivtpnnimfd phksdplvie ngceeyglic pmeevvsial yndishmkik dalpsdlpqd
301 lcplyrpgew edlasekdin pfskfksink ekrqqngeki mtsdsrpivp lekstghtpt
361 kpsgssvsek lkkldssret shgsptvtkl skepsdtssa festakenfl geddvfdle
421 elssqtgggm hkkdtlkecl sldpeerkka esqinnsave mqvqsalafl gtendvelkg
481 aldletcekq dimpevdkqs gspesrvent inihedldkv klieyyltkn kegpqvsenl
541 qktelsdgks iepggiditl ssslsqagdp itegnkepdk twvkkgeplp vklnsstean
601 vikealdssl estldnscqg aqmdnksevq lwllkriqvp iedilpskee ksktppmflc
661 ikvgkpmrks fathtaamvq qygkrrkqpe ywfavprerv dhlytffvqw spdvygkdak
721 eggfvvveke elnmidnffs epttksweii tveeakrrks tcsyyedede evlpvlrphs
781 allenmhieq larrlparvq gypwrlayst lehgtslktl yrksasldsp vlvikdmdn
841 qifgayathp fkfsdhyygt getflytfsp hfkvfkwsge nsyfingdis slelggggr
901 fglwldadly hgrsnscstf nndilskked fivqdlevwa fd
```

FIG. 46
Nix1 (NIP3L; BNIP3H; BNIP3a)
*Homo sapiens*

```
  1 mlififplslp wrpscwkesc stgqrqagrs redsvtppps spwptppaga mstkqearrd
 61 egeartrgqe aqlrdrahls qqrrlkqatq flhkdsadll pldslkrlgt skdlqprsvi
121 qrrlvegnpn wlqgepprmq dlihgqesrr ktsrteipal lvnckcqdql lrvavdtgtq
181 ynrisagcls rlglekrvlk asagdlapgp ptqveqlelq lgqetvvcsa qvvdaespef
241 clglqtllsl kccidlehgv lrlkapfsel pfiplyqepg q
```

FIG. 47
LCoR (MLR2)
*Homo sapiens*

```
  1 mqrmiqqfaa eytsknsstq dpsqpnstkn qslpkaspvt tsptaattqn pvlskllmad
 61 qdspldltvr ksqsepseqd gvldlstkks pcagstslsh spgcsstqgn grpgrpsqyr
121 pdglrsgdgv pprslqdgtr egfghstslk vplarslqis eellsrnqls taaslgpsgl
181 qnhgqhlils reaswakphy efnlsrmkfr gngalsnisd lpflaensaf pkmalqakqd
241 gkkdvshssp vdlkipqvrg mdlswesrtg dqysysslvm gsqtesalsk klrailpkqs
301 rksmldagpd swgsdaeqst sgqpyptsdq egdpgskqpr kkrgryrqyn seileeaisv
361 vmsgkmsvsk aqsiygiphs tleykvkerl gtlknppkkk mklmrsegpd vsvkieldpq
421 geaaqsanes kne
```

FIG. 48A
N-CoR (TRAC1; NCOR1)
*Homo sapiens*

```
   1  msssgyppnq  gafsteqsry  pphsvqytfp  ntrhqqefav  pdyrsshlev  sqasqllqqq
  61  qqqlrrrps  llsefhpgsd  rpqerrtsye  pfhpgpspvd  hdsleskrpr  leqvsdshfq
 121  rvsaaviplv  hplpegiras  adakkdpafg  gkheapsspi  sgqpcgddqn  aspskiskee
 181  liqsmdrvdr  eiakveqqil  klkkkqqqle  eeaakppepe  kpvspppveq  khrsivqiiy
 241  denrkaeea  hkifeglgpk  velplynqps  dtkvyhenik  tnqvmrkkli  lffkrrnhar
 301  kqreqkicqr  ydqlmeawek  kvdriennpr  rkakesktre  yyekqfpeir  kqreqqerfq
 361  rvgqrgagls  atiarsehei  seiidglseq  ennekqmrql  svippmmfda  eqrrvkfinm
 421  nglmedpmkv  ykdrqfmnvw  tdhekeifkd  kfiqhpknfg  liasylerks  vpdcvlyyyl
 481  tkknenykal  vrrnygkrrg  rnqqiarpsq  eekveekeed  kaektekkee  ekkdeeekde
 541  kedskentke  kdkidgtaee  teereqatpr  grktansqgr  rkgritrsmt  neaaaasaaa
 601  aaateepppp  lppppepist  epvetsrwte  eemevakkgl  vehgrnwaai  akmvgtksea
 661  qcknfyfnyk  rrhnldnllq  qhkqktsrkp  reerdvsqce  svastvsaqe  dedieasnee
 721  enpedsevea  vkpsedspen  atsrgntepa  veleptteta  pstspslavp  stkpaedesv
 781  etqvndsisa  etaeqmdvdq  qehsaeegsv  cdpppatkad  svdvevrvpe  nhaskvegdn
 841  tkerdldras  ekveprdedl  vvaqqinaqr  pepqsdndss  atcsadedvd  geperqrmfp
 901  mdskpsllnp  tgsilvsspl  kpnpldipql  qhraavippm  vsctpcnipi  gtpvsgyaly
 961  qrhikamhes  alleeqrqrq  eqidlecrss  tspcgtsksp  nrewevlqpa  phqvitnlpe
1021  gvrlpttrpt  rppplipss  kttvasekps  fimggsisqg  tpgtyltshn  qasytqetpk
1081  psvgsisigl  prqqesaksa  tlpyikqeef  sprsqnsqpe  gilvraqheg  vvrgtagaiq
1141  egsitrgtpt  skisvesips  lrgsitqgtp  alpqtgipte  alvkgsisrm  piedsspekg
1201  reeaaskghv  iyegksghil  sydniknare  gtrsprtahe  islkrsyesv  egnikqgmsm
1261  respvsaple  glicralprg  sphsdlkert  vlsgsimggt  prattesfed  glkypkqikr
1321  esppirafeg  aitkgkpydg  ittikemgrs  iheiprqdil  tqesrktpev  vqstrpiieg
1381  sisqgtpikf  dnnsgqsaik  hnvksliitgp  sklsrgmppl  eivpenikvv  ergkyedvka
1441  getvrsrhts  vvssgpsvlr  stlheapkaq  lspgiyddts  arrtpvsyqn  tmsrgspmmn
1501  rtsdvtissn  kstnherkst  ltptqresip  akspvpgvdp  vvshspfdph  hrgstagevy
1561  rshlpthldp  ampfhraldp  aaaaylfqrq  lsptpgypsq  yqlyamentr  qtilndyits
1621  qqmqvnlrpd  varglspreq  plglpypatr  giidltnmpp  tilvphpggt  stppmdrity
1681  ipgtqitfpp  rpynsasmsp  ghpthlaaaa  saerererer  ekerereria  aassdlylrp
```

FIG. 48B

```
1741  gseqpgrpgs hgyvrspsps vrtqetmlqq rpsvfqgtng tsvitpldpt aqlrimplpa
1801  ggpsisqglp asryntaada laalvdaaas apqmdvsktk eskheaarle enlrsrsaav
1861  seqqleqkt levekrsvqc lytssafpsg kpqphssvvy seagkdkgpp pksryeeelr
1921  trgkttitaa nfidviitrq iasdkdarer gsqssdssss lsshryetps daievispas
1981  spappqeklq tyqpevvkan qaendptrqy egplhhyrpq qespspqqql ppssqaegmg
2041  qvprthrlit ladhicqiit qdfarnqvss qtpqqpptst fqnspsalvs tpvrtktsnr
2101  yspesqaqsv hhqrpgsrvs penlvdksrg srpgkspers hvssepyepi sppqvpvvhe
2161  kqdslllsq rgaepaeqrn darspgsisy lpsfftklen tspmvkskkq eifrklnssg
2221  ggdsdmaaaq pgteifnlpa vttsgsvssr ghsfadpasn lglediirka lmgsfddkve
2281  dhgvvmsqpm gvvpgtants vvtsgetrre egdpsphsgg vckpklisks nsrkskspip
2341  gggylgterp ssvssvhseg dyhrqtpgwa wedrpsstgs tqfpynpltm rmlsstppt p
2401  iacapsavnq aaphqqnriw erepapllsa qyetlsdsdd
```

FIG. 49A
SMRT (NCOR2; SMAP270; TRAC)
*Homo sapiens*

```
   1  msgstqpvaq twratepryp phslsypvqi arthtdvgll eyqhhsrdya shlspgsiiq
  61  pqrrpslls  efqpgnersq elhlrpeshs ylpelgksem  efieskrprl  ellpdpllrp
 121  spllatgqpa gsedltkdrs ltgklepvsp pspphtdpel  elvpprlske eliqnmdrvd
 181  reitmveqqi sklkkkqqql eeeaakppep ekpvspppie  skhrslvqii ydenrkkaea
 241  ahrileglgp qvelplynqp sdtrqyheni kinqamrkkl  ilyfkrrnha rkqweqkfcq
 301  rydqlmeawe kkveriennp rrrakeskvr eyyekqfpei  rkqrelqerm qsrvgqrgsg
 361  lsmsaarseh evseiidgls eqenlekqmr qlavippmly  dadqqrikfi nmnglmadpm
 421  kvykdrqvmn mwseqeketf rekfmqhpkn fgliasfler  ktvaecvlyy yltkknenyk
 481  slvrrsyrrr gksqqqqqqq qqqqqqqqqq pmprssqeek  dekekekeae keeeekpeven
 541  dkedllkekt ddtsgednde keavaskgrk tansqgrrkg  ritrsmanea nseeaitpqq
 601  saelasmeln essrwteeem etakkglleh grnwsaiarm  vgsktvsqck nfyfnykkrq
 661  nldeilqqhk lkmekernar rkkkkapaaa seeaafppvv  edeemeasgv sgneeemvee
 721  aealhasgne vprgecsgpa tvnnssdtes ipsphteaak  dtgqngpkpp atlgadgppp
 781  gpptpppedi papteptpas eatgaptppp appspsappp  vvpkeekeee taaappveeg
 841  eeqkppaaee lavdtgkaee pvksecteea eegpakgkda  eaaeataega lkaekkeggs
 901  grattakssg apqdsdssat csadevdeae ggdknrllsp  rpslltptgd pranaspqkp
 961  ldlkqlkqra aaippiqvtk vheppredaa ptkpappapp  ppqnlqpesd apqqpgsspr
1021  gksrspappa dkeafaaeaq klpgdppcwt sglpfpvppr  evikasphap dpsafsyapp
1081  ghplplglhd tarpvlprpp tisnpsplis sakhpsvler  qigaisqgms vqlhvpyseh
1141  akapvgpvtm glplpmdpkk lapfsgvkqe qlsprgqagp  peslgvptaq easvlrgtal
1201  gsvpggsitk gipstrvpsd saityrgsit hgtpadvlyk  gtitriiged spsrldrgre
1261  dslpkghvly egkkghvlsy eggmsvtqcs kedgrsssgp  phetaapkrt ydmmegrvgr
1321  aissasiegl mgraipperh sphhlkeqhh irgsitqgip  rsyveaqedy lrreaklikr
1381  egtppppps  rdlteayktq algplkikpa heglvatvke  agrsiheipr eelrhtpelp
1441  laprplkegs itqgtplkyd tgasttgskk hdvrsligsp  grtfppvhpl dvmadarale
1501  racyeeslks rpgtasssgg siargapviv pelgkprqsp  ltyedhgapf aghlprgspv
1561  ttreptprlq egslssskas qdrkltstpr eiaksphstv  pehhphpisp yehllrgvsg
1621  vdlyrshipl afdptsiprg ipldaaaayy lprhlapnpt  yphlyppyli rgypdtaale
1681  nrqtiindyi tsqqmhhnaa tamaqradml rglspressl  alnyaagprg iidlsqvphl
```

FIG. 49B

```
1741 pvlvpptpgt patamdrlay lptapqpfss rhssplspg gpthltkptt tsssererdr
1801 drerdrdrer eksiltsttt vehapiwrpg teqssgssgg gggsssrpas hshahqhspi
1861 sprtqdalqq rpsvlhntgm kgiitaveps tptvlrstst sspvrpaatf ppathcplgg
1921 tldgvyptlm epvilpkeap rvarperpra dtghaflakp parsglepas spskgseprp
1981 lvppvsghat iartpaknla phhaspdppa ppasasdphr ektqskpfsi qelelrslgy
2041 hgssyspegv epvspvssps lthdkglpkh leeldkshle gelrpkqpgp vklggeaahl
2101 phirplpesq psspllqta pgvkghqrvv tlaqhisevi tqdytrhhpq qlsaplpapl
2161 ysfpgascpv ldlrrppsdl ylpppdhgap argsphsegg krspepnkts vlgggedgie
2221 pvsppegmte pghsrsavyp llyrdgeqte psrmgskspg ntsqppaffs kltesnsamv
2281 kskkqeinkk lnthnrnepe ynisqpgtei fnmpaitgtg lmtyrsqavq ehastnmgle
2341 aiirkalmgk ydqweesppl sanafnplna saslpaampi taadgrsdht ltspggggka
2401 kvsgrpssrk akspapglas gdrppsvssv hsegdcnrrt pltnrvwedr pssagstpfp
2461 ynplimrlqa gvmasppppg lpagsgplag phhawdeepk plicsqyetl sdse
```

FIG. 50
RIP140 (NRIP1)
*Homo sapiens*

```
   1 mthgeelgsd vhqdsivlty leglimhqaa ggsgtavdkk saghneedqn fnisgsafpt
  61 cqsngpvlnt htyqgsgmih lkkarliqss edwnaakrkr lsdsimnlnv kkeallagmv
 121 dsvpkgkqds tilasllqsf ssrlqtvals qqirqslkeq gyalshdslk vekdlrcygv
 181 asshlktllk kskvkdqkpd tnlpdvtknl irdrfaesph hvgqsgtkvm seplscaarl
 241 qavasmvekr aspatspkps vacsqlalll sseahlqqys rehalktqna nqaaserlaa
 301 marlqengqk dvgsyqlpkg msshlnggar tsssklmask ssatvfqnpm giipsspkna
 361 gyknslernn ikqaannsll lhllksqtip kpmnghshse rgsifeesst pttideysdn
 421 npsftddssg dessysncvp idlsckhrte ksesdqpvsl dnftqsllnt wdpkvpdvdi
 481 kedqdtskns klnshqkvtl lqllghkne enveknstspq gvhndvskfn tqnyartsvi
 541 espstnrttp vstppllss kagspinlsq hslvikwnsp pyvcstqsek ltntasnhsm
 601 dltkskdppg ekpaqnegaq nsatfsaskl lqnlaqcgmq ssmsveeqrp skqlltgntd
 661 kpigmidrln splisnktna veenkafssq ptgpepglsg seienllerr tvlqlilgnp
 721 nkgksekkek tplrdestqe hseralseqi lmvkiksepc ddlqipntnv hlshdaksap
 781 flgmapavqr sapalpvsed fksepvspqd fsfsknglls rllrqnqdsy laddsdrshr
 841 nnemallesk nlcmvpkkrk lyteplenpf kkmknnivda annhsapevl ygsllnqeel
 901 kfsrndlefk ypaghgsase sehrswares ksfnvlkqll lsencvrdls phrsnsvads
 961 kkkghknnvt nskpefsiss lnglmysstq psscmdnrtf sypgvvktpv sptfpehlgc
1021 agsrpesgll ngcsmpsekg pikwvitdae kneyekdspr ltktnpilyy mlqkggnsvt
1081 sretqdkdiw reassaesvs qvtakeellp taetkasffn lrspynshmg nnasrphsan
1141 gevygllgsv ltikkese
```

FIG. 51A
PRIC285 (PDIP-1)
*Homo sapiens*

```
   1 mssspsrsaa diyireyfhs hvsgghpeat plrvmytdrp lsqtdpvtlq yccltddrqa
  61 frpptraela rhrvvvttts qarelrvpvg ffshilidea aqmlecealt playashgtr
 121 lvlagdhmqv tprlfsvara raaehtlihr lflcyqqeth evargsrlvf henyrctdai
 181 vsfisrhfyv akgnpiharg kvpphprhyp lmfchvagsp drdmsmaswl nlaeiaqvve
 241 kvqeayntwp scwggreqrc icvvshgaqv salrqelrrr dlgqvsvgsf eilpgrqfrv
 301 vvlstvhtcq slispgalap efftdarvln tvltraqsql dlgqvdavalc sfgacgklwe
 361 sfirecverh svcpeglsme qveqgvaqrr rwpprgtqag aagnweaape pvgdlaeeqa
 421 avvtamvkae pgdealspas rditattaqt eaaaapagda vkedvvpgac aagaaaaagv
 481 esteaedaea dfwpwdgeln addailrell desqkvmvtv gedglidtva rpeslqqarl
 541 yenlppaalr kllhaepery rhcsfvpetf erasaipldd assgpiqvrg rldcgmafag
 601 devlvqllsg dkapegrlrg rvlgvlkrkr helafvcrmd twdprimvpi ngsvtkifva
 661 elkdpsqvpi yslrkgrlqr vglerltaea rhsrlfwvqi vlwrqgfyyp lgivrevlpe
 721 astweqglri lgleyslrvp psdqatitkv lqkyhtelgr vagrredcra fltftvdpqg
 781 acnlddalsv rdlgprceva vhitdvasfv prdgvldvea rrqgaafyap grepvpmlpa
 841 slcqdvlsll pgrdrlaisl fltmekasgq lkslrfapsv vqsdrqlsye eaeevirqhp
 901 gagrelparl dsvdacvvaa cyfsrllrrh rlrsdcfyeq pdedgtlgfr aahimvkeym
 961 iqfnrlvaef lvgsectrtv tplrwqpapr sqqlkalcek hgdrvplslh lghhlhgggg
1021 sppdtrlhll aslwkqvqfa artqdyeqmv dlvttddmhp flapagrdlr kalersafgr
1081 carghqqggg hyslqvdwyt watspirryl dvvlqrqill alghggsays ardidglcqa
1141 fslqhalaqs yqrrarslhl avqlkaqpld klgfvvdvea gsrcfrllfp snretlpdpc
1201 pvpygslqla ehphalagrp glrllwrrrv ysaqgssppl plpgtvpdph tlavetalwk
1261 qllelvelqr wpeaaaliqe kgeasqrrel vqvqrshcgh flevarelgs gdtlqvqlgt
1321 slqhgflvps pqlwtvapgf slclehverp gdcfsgrvyr aprdryrdvd eyacvwepfc
1381 alesatgava endsvtlqhl svsweasrtp qgqlqgafrl eaafleenca dinfsccylc
1441 irleglpapt asprpgpssl gpglnvdpgt ytwvahgqtq dwdqerradr qeaprrvhlf
1501 vhhmgmekvp eevlrpgtlf tvellpkqlp rhklnpsqnv avrealekpf leeasplvts lalgrpvpqp
1561 lcrvipsrfl erqtynipgg rhklnpsqnv avrealekpf tviqgppgtg ktivglhivf
1621 wfhksnqeqv qpggpprgek rlggpcilyc gpsnksvdvl aglllrrmel kplrvyseqa
```

FIG. 51B

```
1681 easefpvprv gsrkllrksp regrpnqslr sitlhhrirq apnpysseik afdtrlqrge
1741 lfsredlvwy kkvlwearkf eldrhevilc tcscaasasl kildvrqilv deagmatepe
1801 tliplvqfpq aekvvllgdh kqlrpvvkne rlqnigldrs lferyhedah mldtqyrmhe
1861 gicafpsvaf yksklktwqg lrrppsvlgh agkescpvif ghvqghersl lvstdegnen
1921 skanleevae vvritkqltl grtvepqdia vltpynaqas eiskalrreg iagvavssit
1981 ksqgsewryv lvstvrtcak sdldqrptks wlkkflgfvv dpnqvnvavt raqeglclig
2041 dhillrccpl wrslldfcea qqtlvpagqv rvcrrptmps
```

FIG. 53

| IL-2 receptor family member | UniProt ID | RefSeq Accession | Amino Acid Sequence |
|---|---|---|---|
| Interleukin 13 receptor, α2 | Q14627 | NP_000631.1 | MAFVCLAIGCLYTFLISTTFGCTSSSDTEIKVNPPQDFEIVDPGVLGYLYLQWQPPLSLDHFKECTVEYELKYRNIGSETWKTIITKNLHYKDGFDLNKGIEAKIHTLLPWQCTNG SEVQSSWAETTYWISPQGIPETKVQDMDCVYYNWQYLLCSWKPGIGVILLDTNYNLFYWYEGLDHALQCQVDVIKADGQNIGCRFPYLEASDYKDFYICVNGSSENKPIRSSYF TFQLQNIVKPLPPVYLTFTRESSCEIKLKWSIPLGRIPARCFDYEIEIREDDTTLVTATVENETYTLKTTNETRQLCFVVRSKVNIYCSDDGIWSEWSDKQCWEGEDLSKKTLRF WLPFGFHLLVIFVTGILLLRKPNTYPKMIPEFFCDT |
| Interleukin-2 receptor subunit α | P01589 | NP_000408.1 | MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEM QSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTT TDFQIIQTEMAATMETSJFTTEYQVAVAGCVFLLISVLLLSGLTWQRRQRKSRRTI |
| Interleukin-2 receptor subunit β | P14784 | NP_000869.1 | MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLC REGVRWRVRVMAIQDFKPFENLRLMAPISLQVHVETHRCNISWEISCQASHYFERHLEFEARTLSPGHTWEEAPLLTLKQKQEWICLETLTPDTQYEFQVRVKPLQGEFTTWSP WSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLL LQQDKVPEPASLSSNHSLTSCFTNQGYFFHLPDALEIEACQVYFTYDPYSEEDPDEGVAGAPTGSSPQPLQPLSGEDDAVCTFPSRDDLLFSPSLLGGPSPPSTAPGGSGAG EERMPPSLQERVPRDWDPQPLGPPTPGVPDLVDFQPPPELVLREAGEEVPDAGPREGVSPWSRPPGQGEFRALNARLPLNTDAYLSLQELQGQDPTHLV |
| Interleukin-2 receptor subunit γ | P31785 | NP_000197.1 | MLKPSLPFTSLFLQLPLLGVGLNTTIL'TPNGNEDTTADFFLTTMPTDSLSVSTLPLPEVQCFVFNVEYMNCTWNSSSEPQPTNLTLHYWYKNSDNDKVQKCSHYLFSEETSG CQLQKKEIHLYQTFVVQLQDPREPRRQATQMLKLQNLVIPWAPENLTLHKSLESQLELNWNNRFLNHCLEHLVQRTDWDHSWTEQSVDYRHKFSLPSVDGQKRYTFRV RSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPP KGGALGEGPGASPCNQHSPYWAPPCYTLKPET |
| Interleukin-4 receptor subunit α | P24394 | NP_000409.1 | MGWLCSGLLFPVSCLVLLQVSSGNMKVLQEPTCVSDYMSISTCEWKMNGPTNCSTELRLLYQLVFLLSEAHTCIPENNGGAGCVCHLLMDDVVSADNYTLDLWAGQQL LWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTK WHNSYREPFEQHLLIGVSVSCIVILAVCLLCYVSITRIKKEWWDQIPNPARSRLVAIIIQDAQGSQWEKRSRGQEPAKCPHWKNCLTKLLPCFLEHNMKRDEDPHKAAKEMP FQGSGKSAWCPVEISKTVLWPESISVRVCVELFEAPVECEEEEEEKGSFCASPESSRDDFQEGREGIVARLTESLFLDLLGEENGGFCQQDMGESCLLPPSGSTSAHMPW DEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVL QHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLP SSSPEHGLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPS GISEKSKSSSSFHPAPGNAQSSSQTPKIVNFVSVGPTYMRVS |
| Interleukin-7 receptor subunit α | P16871 | NP_002176.2 | MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSL TCKKIDLTTIVKPEAPFDLSVVYREGANDFVVFNTSHLQKKYVKVLMHDVAYRQEKDENKWTHVNLSSTKLTLLQRKLQPAAMYEIKVRSIPDHYFKGFWSEWSPSYYFRT PEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDV QSPNCPSEDVITPESFGRDSSLTCLAGNVSACDAPILSSSRSLDCRESGKNGPHVYQDLLLSGTTNSTLPPPFSLQSGILTLNPVAQGQPILTSLGSSNQEEAVVTMSSFYQNQ |
| Interleukin 9 receptor | Q01113 | NP_002177.2 | MGLGRCIWEGWTLESEALRRDMGTWLLACICICTCVCLGVSVTGEGQPRSRTFTCLTNNILRIDCHWSAPELGQGSSPWLLFTSNQAPGGTHKCILRGSECTVLPPEAVL VPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRV QMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGV LLSQDCAGTPQGALEPGCVQEATALLTCGPARPWKSVALEEEOEGPGTRLPGNLSSEDVLPAGCTEWRVQTLAYLPQEDWAPTSLTRPAPPDSEGSRSSSSSSSNNNNYCA LGCYGGWHLSALPGNTQSSGPIPALACGLSCDHQGLETQQGVAWVLAGHCQRPGLHEDLQGMLLPSVLSKARSWTF |
| Interleukin-13 receptor subunit α1 | P78552 | NP_001551.1 | MEWPARLCGLWALLLCAGGGGGGGGGAAPTETQPPVTNLSVSVENLCTVIMTWNPPEGASSNCSLWYSHFGDKQDKKIAPETRRSIEVPLNERICLQVGSQCSTNESEKP SILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTS RVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEM SIGKKRNSTLYITMLLIVPVIVAGAIIVLLLYKRLKIIIFPPIPDPGKIFKEMFGDQNDDTLHWKKYDIYEKQTKEETDSVVLIENLKKASQ |

FIG. 53 (CONT.)

| | | | |
|---|---|---|---|
| Interleukin-15 receptor subunit α | Q13261 | NP_001230468.1 | MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL |
| Interleukin 21 receptor | Q9HBE5 | NP_068570.1 | MPRGWAAPLLLLLQGGWGCPDLVCYTDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGPLGSLLDRLKPPLADGEDWAGGLPWGGRSPGGVSESEAGSPLAGLDMDTFDSGFVGSDCSSPVECDFTSPGDEGPPRSYLRQWVVIPPLSSPGPQAS |
| Cytokine receptor-like factor 2 | Q9HC73 | NP_001012288.2 | MVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL |

FIG. 54

| IL-3 receptor family | UniProt ID | RefSeq Accession | Amino Acid Sequence |
|---|---|---|---|
| Interleukin 3 receptor, α subunit | P26951 | NP_001254 64.2 | MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSA AFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGAN TRAWRTSLLIALGTLLALVCVFVICRRYLVMQRLFPRIPHMKDPIGDSFQNDKLVVWEAGKAGLEECLVTEVQVVQKT |
| Interleukin 5 receptor, α subunit | Q01344 | NP_000555.2 | MIIVAHVLILLLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASA ELHAPPGSPGTSIVNLTCTTNTTEDNYSRLRSYQVSLHCTWLVGTDAPEDTQYFLYYRGSWTEECQEYSKDTLGRNIACWFPRTFILSKGRDWLAVLVNGSSKHSAIRPFDQ LFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWF VIVIMATICFILLILSLICKICHLWIKLFPPIPAPKSNIKDLFVTTNYEKAGSSETEIEVICYIEKPGVETLEDSVF |
| GM-CSF receptor, α subunit | P15509 | NP_001155 00.1 | MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNS GREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRC NTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIV LGFLFKRFLRIQRLFPPVPQIKDKLNDNHEVEDEIIWEEFTPEEGKGYREEVLTVKEIT |
| Cytokine receptor common β subunit | P32927 | NP_000386.1 | MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVTDVDYF SFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLS GRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKS SVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPM WVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTP AASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPS LESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPIEGRSPRSP RNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNK PGEVC |

FIG. 55

| IL-6 receptor family | UniProt ID | RefSeq Accession | Amino Acid Sequence |
|---|---|---|---|
| Leptin receptor | P48357 | NP_001003679.1 | MICQKFCVVLLHWEFLYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTV NSLVFQQIDANWNIQCWLKGDLKLFICYVESLFKNLFRNYNYKVHLLYVLPEVLEDSPLVPQKGSFQMVHCNCSVHECCECLVPTAKLNDTLLMCLKITSGGVIFQSPLMS VQPINMVKPDPPLGLHMEITDDGNLKISIWSSPPPLVPFPLQYQVKYSENSTTVIREADKIVSATSLLVDSILPGSSYEVQVRGKRLDGPGIWSDWSTPRVFTTQDVIYFPPKILTS VGSNVSFHCIYKKENKIVPSKEIVWWMNLAEKIPQSQYDVVSDHVSKVTFENLNETKPRGKFTYDAVYCCNEHECHRYAELYVIDVNINSCETDGYLTKMTCRWSTSTIQS LAESTLQLRYHRSSLYCSDIPSIHPISEPKDCYLQSDGFYECIFQPIFLLSGYTMWRINHSLGSLDSPPTCVLPDSVVKPLPPSSVKAEITINIGLLKISWEKPVFPENNLQFQJRYGL SGKEVQWKMYEVVYDAKSKSVSLPVPDLCAVVAVQVRCKRLDGLGYWSNWSNPAYTVVMDKVPMRGPEFWRIINGDTMKKEKNVTLLWKPLMKNDSLCSVQRYVINH HTSCNGTWSEDVGNHTKFTFLWTEQAHTVTVLAINSIGASVANFNLTFSWPMSKVNIVQSLSAYPLNSSCVIVSWILSPSDYKLMYFHIEWKNLNEDGEIKWLRISSSVKKYYI HDHFIPIEKYQFSLYPIFMEGVGKPKIINSFTQDDIEKHQSDAGLYVIVPVIISSSILLGTLLISHQRMKKLFWEDVPNPKNCSWAQGLNFQKRTDIL |
| IL6R (Interleukin-6 receptor, α subunit / interleukin 6 receptor) | P08887 | NP_000556.1 | MLAVGCALLAALLAAPGAALAPRRCPAQEVARGVLTSLPGDSVTLTCPGVEPEDNATVHWVLRKPAAGSHPSRWAGMGRRLLRSVQLHDSGNYSCYRAGRPAGTVHLL VDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANI TVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVS TPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTS SHNRPDARDPRSPYDISNTDYFPR |
| IL6ST (Interleukin-6 receptor, β subunit / interleukin 6 signal transducer) | P40189 | NP_002175.2 | MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVY GITIISGLPPEEKPKNLSCIVNEGKKMRCEWDGGRETHLETNFTLKSEWATHKFADCKAKRDTPTSCTVDYSTVYFVNIEVWVEAENALGKVTSDHINFDPVYKVNPPHNLS VNSEELSSILKLTWTNPSIKSVIILKYNIQYRTKDASTWSQPPEDTASTRSSFTVQDLKPTTEYVFRIRCMKEDGKGYWSDWSEEASGITYEDRPSKAPSFWYKIDPSHTQGYR TVQLVWKTLPPFEANGKILDYEVTLTRWKSHLQNYTVNATKLTVNLTNDRYLATLTVRNLVGKSDAAVLTIPACDFQGNLAESKCYLITVTPVYADGPGSPESIKAYLKQAPPS KGPTVRTKKVGKNEAVLEWDQLPVDVQNGFHRNYTFYRTIIGNETAVNVDSSHTEYTLSSLTSDTLYMVRMAAYTDEGGKDGPEFTFTPKFAQGEIEAIVVPVCLAFLLTTL LGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENE SSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCG SGQMKMFQEVSAADAFGPGTEGQVRERFETVGMEAATDEGMPKSYLPQTVRQGGYMPQ |
| Interleukin-11 receptor, α subunit | Q14626 | NP_001136255.1 | MSSSCSGLSRVILVAVATALVSASSPCPQAWGPAEVQYVQGQPGRSVKLLCCPGVTAGDPVSWFRDGEPKLLQGPDSGLGHELVLAQADSTDEGTYICCTLDGALGTVTLQLG YPPARPVVSCQAADYENFSCTWSPSQJSGLPTRYLTSYRKKTVLGADSQRRSPTGPWPCPQDPLGAARCVVHGAEFWSQYRINVTEVNPLGASTRLLDVSLQSILRPDPPQ GLRVESVPGVPRRLRASWTYPASWPCCQPHFLLKFRLQYRPAQHPAWSTVEPAGLEEVITDAVAGLPHAVRVSARDFLDAGTWSTWSPEAWGTPSTGTIPKEIPAWGQLH TQPEVEPQVDSPAPPRPSLQPHPRLLDHRDSVEQVAVLASLGILSFLGLVAGALALGIWLRLRRGGKDGSPKPGFLASVIPVDRRPGAPNL |
| Interleukin-27 receptor, alpha | Q6UWB1 | NP_004834.1 | MRGGRGAPFWIWLPLPKLALLPLLWVLFQRTRPQGSAGPLQCYGVGPLGDLNCSWEPLGDGAPSELHLQSQKYRSNKTQTVAVAAGRSWVAIPREQLTMSDKLLVWGT KAGQPLWPPVFVNLETQMKPNAPRLGPDVDFSEDDPLEATVHWAPPTWPSHKVLLCQFHYRRCQEAAWTLLEPELKTIPLTPVEIQDLELATGYKVYGRCRMEKEEDLWG EWSPILSFQTPPSAPKDVWVSGNLCGTPGGEPLEHVVDWARDGDPLEKINWVRLPGNLSALLPGNFTVGPVPRITVTAVSASGLASASSVWGFREELAPLVGPTLWRLQDAPPGTPAIAWGE SIAGSTELLVTWQPGPGEPLEHVVDWARDGDPLEKINWVRLPGNLSALLPGNFTVGPVPRITVTAVSASGLASASSVWGFREELAPLVGPTLWRLQDAPPGTPAIAWGE VPRHQLRGHLTHYTLCAQGSGTSPSVCMNVSGNTQSVTLPDLPWGPCELWVTASTIAGQGPPGPILRHLPDNTLRWKVLPGILFLLGCGLSLATSGRCYHLRHKVLP RWVVWEKVPDPANSSSGQPHMEQVPEAQPLGDLPILEVEMEPPPVMESSQPAQATAPLDSGYEKHFLPTPEELGLLGPPRPQVLA |
| Interleukin-31 receptor, α subunit | Q8NI17 | NP_001242956.1 | MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVE AENGDGVIKSHMITYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWS DWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQ EKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVE NIGVKTVTITWKEIPKSERKGIICNYTIFYQAEGGKGFSKTVNSSILQYGLESLKRKTSYIVQVMASTSAGGTNGTSINFKTLSFSVFEILILTSLIGGGLILILTLVAYGLKKPNKLTHL CWPTVPNPAESSIATWHGDDFKDKLNLKESDDSVNTEDRILKPCSTPSDKLVIDKLVVNFGNVLQEIFTDEARTGQENNLLGGEKNGVTCPFRPDCPLGKSFEELVSPEIPP RKSQYLRSRMPEGTRPEAKEQLLFSGQSLVPDHLCEEGAPNPYLKNSVTAREFLVSEKLPEHTKGEV |

FIG. 55 (CONT.)

| | | |
|---|---|---|
| Ciliary neurotrophic factor receptor α subunit | P26992 | NP_001119394.1 | MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPPLKFFLRYRPLILDQWQHVELSDGTAHTITDAYAGKEYIIQVAAKDNEIGTWSDWSVAAHATPWTEEPRHLTTEAQAAETTSTTSSLAPPPTTKICDPGELGSGGGPSAPFLVSVPITLALAAAAATASSLLI |
| Leukemia inhibitory factor receptor | P42702 | NP_001127113.1 | MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCVRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND |
| Oncostatin M-specific receptor, β subunit | Q99650 | NP_001167.1 | MALFAVFQTFFLTLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH |

FIG. 56

| IL-12 receptor family | UniProt ID | RefSeq Accession | Amino Acid Sequence |
|---|---|---|---|
| Interleukin-12 receptor, β1 subunit | P42701 | NP_001279 5.1 | MEPLVTWVPLLFLFLLSRQGAACRTSECFCQDPPYPDADSGSASGPRDLRCYRISSDRYECSWQYEGPTAGVSHFLRCCLSSGRCCYFAAGSATRLQFSDQAGVSVLYTVTL WVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRQLGSQGSS WSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQT WHIPADTHTEPVALNISVGTNGTTMYWPARAQSMTYCIEWQPVGQDGGLATCSLTAPQDPPAGMATYSWRESGAMGQEKCYITIFASAHPEKLTLWSTVLSTYHF GGNASAAGTPHHVSVKNHSLDSVSVDWAPSLLSTCPGVLKEYVVRCRDEDSKQVSEHPVQPTETQVTLSGRAGVAYTVQVRADTAWLRGVWSQPQRFSIEVQVSDWLI FFASLGSFLSILLVGVLGYLGLNRAARHLCPPLPTPCASSAIEFPGGKETWQWINPVDFQEEASLQEALVEMSWDKGERTEPLEKTELPEGAPELALDTELSLEDGDRCDR |
| Interleukin-12 receptor, β2 subunit | Q99665 | NP_001245 14.1 | MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGA EIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDI RIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQI SLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAV QEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDS NSQPQLCEIPYRVSQNSHPINSLQPRVTYVYLVWMTALTAAGESSHGNEREFCLQGKANWMAFVAPSICIAIIMVGIFSTHYFQQKRRHSCPWTGS |
| Interleukin 23 receptor | Q5VWK5 | NP_653302.2 | MNQVTIQWDAVIALYILFSWCHGGITNINCSGHIWVEPATIFKMGMNISIYCQAAIKNCQPRKLHFYKNGIKERFQTRINKTTARLWYKNFLEPHASMYCTAECPKHFQET LICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISR AETINATVPKTIIYWDSQTTIEKVYSCEMRYKATTNQTWNVKEFDTNFTYVQQSEFYLEPNIKYVFQVRCQETGKRYWQPWSSLFFHKTPETVPQVTSKAFQHDTWNSGLTV ASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENT GPLETRDYPQNSLFDNTTVVYIPDLNTGYKPQISNFLPEGSHLSMNNEITSLTLKPPVDSLDSGNNPRLQKHPNFAFSVSSVNSLSNTIFLGELSILINQGECSSPDIQNSVEET TMLLENDSPSETIPEQTLLPDEFVSCLGVNEELPSINTYFPQNILESHFNRISLLEK |

FIG. 57

| Prolactin receptor family | UniProt ID | RefSeq Accession | Amino Acid Sequence |
|---|---|---|---|
| Eythropoietin receptor | P19235 | NP_000112.1 | MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDDPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS |
| Granulocyte colony-stimulating factor receptor | Q99062 | NP_000751.1 | MARLGNCSLTWAALIILLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLIHNQKCELRHKPQRGEASWALVGPLLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTMTLTPEGSELHIILGFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF |
| Growth hormone receptor | P10912 | NP_000154.1 | MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLVTLPQMSQFTCEEDFYFPWLLIIIFGIFGLTVMLFVLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGVVSTDQLNKIMP |
| Prolactin receptor | P16471 | NP_000940.1 | MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAAPPSLEQNQAEKALANFTATSSKCRLQLGLDYLDPACFTHSFH |
| Thrombopoietin receptor | P40238 | NP_005364.1 | MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQTMPWQDGPKQTSPSREASALTAEGSCLISGLQPGNSYWLQLRSEPDGISLGGSWSWSLPVTVDLPGDAVALGLQCFTLDLKNVTCQWQQQDHASSQGFFYHSRARCCPRDRYPIWENCEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLILLRWQFPAHYRRLRHALWLPSLPDLHRVLGQYLRDTAALSPPKATVSDTCEEVEPSLLEILPKSSERTPLPLCSSQAMDYRRLQPSCLGTMPLSVCPPMAESGSCCTTHIANHSYLPLSYWQQP |

FIG. 58

| Interferon receptor family | UniProt ID | RefSeq Accession | Amino Acid Sequence |
|---|---|---|---|
| interferon α/β receptor 1 | P17181 | NP_000620.2 | MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTS SWYEVDSFTPFRKAQIGPPEVHLEAEDKAIVIHSPGTKDSVMWALDGLSFTYSLVIWKNSSGVEERIENIYSRHKIYKLSPETTYCLKVKAALLTSWKIGVYSPVHCIKTTVENEL PPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNI RSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAA KVFLRCINYVFFPSLKPSSSIDEYFSEOQJEKCFIIENISTIATVEETNQTDEDHKKYSSQTSQDSGNYSNEDESESKTSEELQQDFV |
| Interferon α/β receptor 2 | P48551 | NP_000865.2 | MLLSQNAFIFRSLNLVLMVYISLVFGISYDSPDYTDESCTFKISLRNFRSILSWELKNHSIVPTHYTLLYTIMSKPEDLKVKNCANTTRSFCDLTDEWRSTHEAYVTVLEGFSGN TTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPG QESESAESAKIGGIITVFLIALVLTSTIVTLKWIGYICLRNSLPKVLRQGLAKGWNAVAIHRCSHNALQSETPELKQSSCLSFPSSWDYKRASLCPSD |
| Interferon γ receptor 1 | P15260 | NP_000407.1 | MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQK ESAYAKSEEFAVCRDGKIGPPKLDIRKEEKQIMIDIFHPSVFVNGDEQEVDYDPETTCYIRVYNVYVRMNGSEIQYKILTQKEDDCEIQCQLAIPVSSLNSQYCVSAEGVLHV WGVTTEKSKEVCITIFNSSIKGSLWIPVVAALLLFLVLSLVFICFYIRKINPLKEKSIILPKLSISVVRSATLETKPESKYVSLITSYQPFSLEKEVVCEEPLSPATVPGMHTEDNPGKVE HTEELSSITEVVTTEENIPDVVPGSHLTPIERESSSPLSSMQSEPGSIALNSYHSRNCSESDHSRNGFDTDSSCLESHSSLSDSEFPPNNKGEIKTEGQELITVIKAPTSFGYDKPHV LVDLLVDDSGKESLIGYRPTEDSKEFS |
| Interferon γ receptor 2 | P38484 | NP_005525.2 | MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNV TLRLRAELGALHSAWVTMPWFQHYRNVTVGPPENIEVTPGEGSLIIRFSSPFDIADTSTAFFCYYVHYWEKGGIQQVKGPFRSNSILDNLKPSRVYCLQVQAQLLWNKSNIF RVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL |

FIG. 59

| IL-10 receptor family | UniProt ID | RefSeq Accession | Amino Acid Sequence |
|---|---|---|---|
| Interleukin-22 receptor α2 | Q969J5 | NP_443194.1 | MIMPKHCFLGFLISFFLTGVAGTQSTHESLKPQRVQFQSRNFHNILQWQPGRALTGNSSVYFVQYKIMFSCCSMKSSHQKPSGCWQHISCNFPGCRTLAKYGQRQWKNKEDCWGTQELSCDLTSETSDIQEPYYGRVRAASAGSYSEWSMTPRFTPWWVETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP |
| Interleukin 10 receptor, α subunit | Q13651 | NP_001549.2 | MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIFFAFVLLLSGALAYCLALQLYVRRRKKLPSVLLFKKPSPFIFISQRPSETQDTIHPLDEEAFLKVSPELKNLDLHGSTDSGFGSTKPSLQTEEPQFLLPDHPQADRTLGNREPPVLGDSCSSGSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE |
| Interleukin 10 receptor, β subunit | Q08334 | NP_000619.3 | MAWSLGSWLGGCLLVSALGMVPPPENVRMNSVNFKNILQWESPAFAKGNLTFTAQYLSRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS |
| Interleukin 20 receptor, α subunit | Q9UHF4 | NP_001265651.1 | MKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEVKHLGYASHLMEIFCDSEENTEGTSLTQQESLSRTIPPDKTVIEYEYDVRTTDICAGPEEQELSLQEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN |
| Interleukin 20 receptor, β subunit | Q6UXL0 | NP_653318.2 | MQTFTMVLEEIWTSLFMWFFYALIPCLLTDEVAILPAPQNLSVLSTNMKHLLMWSPVIAPGETVYYSVEYQGEVESLYTSHIWIPSSWCSLTEGPECDVTDDITATVPYNLRVRATLGSSQTSAWSILKHPFNRNSTILTRPGMEITKDGFHLVIELEDLGPQEFFLVAYWMRREPGAAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS |
| Interleukin 22 receptor, α1 subunit | Q8N6P7 | NP_067081.2 | MRTLTLTLTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSRYRVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES |
| Interferon-λ receptor subunit 1 | Q8IU57 | NP_734464.1 | MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATOQTRWKKDLAEDEEEDEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLFCWESSPEEEEARESEIEDSDAGSWGAESTQRTEDRGRTLGHYMAR |

FIG. 60

| IL-17 receptor family | UniProt ID | RefSeq Accession | Amino Acid Sequence |
|---|---|---|---|
| Interleukin 17 receptor A | Q96F46 | NP_001276834.1 | MGAARSPPSAVPGPLLGLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAE LSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLW NESTHYQILLTSFPPHMENHSCFEHMHHIPAPRPEEFHQRSNVTLTLRNLKGCCRHQVQIQPFFSSCLNDCLRHSATVSCPEMPDTPEPIPGPGSEKYSDDTKYTDGLPAADLI PPPLKPRKVWIIYSADHPLYDVVLKFAQFLLTACGTEVALDLLEEQAISEAGVMTWVGRQKQEMVESNSKIIVLCSRGTRAKWQALLGRGAPVRLRCDHGKPVGDLFTAA MNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENL YSADDQDAPSLDEEVFEEPLLPPGTGIVKRAPLVREPGSQACLAIDPLVGEEGAAVAKLEPHLQPRGQPAPQLHTLVLAAEEGALVAAVEPGPLADGAAVRLALAGEGEA CPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEE EEEQDPGKPALPLSPEDLESLRSLQRQLLFRQLQKNSGWDTMGSESEGPSA |
| Interleukin 17 receptor B | Q9NRM6 | NP_061195.2 | MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTR PSGGKWTFSYIGFPVELNTVYFIGAHNIPNANMNEDGPSMSVNFTSPGCLDHIMKYKKCVKAGSLWDPNITACKKNEETVEVNFTTTPLGNRYMALIQHSTIIGFSQVFEP HQKKQTRASVVIPVTGDSEGATVQLTPYFPTCGSDCIRHKGTVVLCPQTGVPPFLDNNKSKPGGWLPLLLLSLLVATWVLVAGIYLMWRHERIKKTSFSTTTLLPPIKVLVVYP SEICFHHTICYFTEFLQNHCRSEVILEKWQKKIAEMGPVQWLATQKKAADKVVFLLSNDVNSVCDGTCGKSEGSPSENSQDLFPLAFNLFCSDLRSQIHLHKYVVYFREIDT KDDYNALSVCPKYHLMKDATAFCAELLHVKQQVSAGKRSQACHDGCCSL |
| interleukin 17 receptor C | Q8NAC3 | NP_0119019.2.1 | MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADS GVEEPRNASLQAQVVLSFQAYPTARCVLLEVQVPAALVQFGQSVGSVVDCFEAALGSEVRIWSYTQPRYEKELNHTQQLPDCRGLEVWNSIPSCWALPMLNVSADGDN VHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCW RAPGGDPCQPLVPPLSWENVTVDKVLEPLLKGHPNLCVQVNSSEKLQLQECLWADSLGPLKDDVLLETRGPQDNRSLCALEPSGCTSLPSKASTRAARLGEYLLQDLQSG QCLQLWDDDLGALWACPMDKYIHKRWALVMWLACLLFAAALSLILLLKKDHAKAAARGRAALLYSADDSGFERLVGALASALCQLPLRVAVDLWSRRELSAQGPVAWFH AQRRQTILQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRS GRLQERAEQVSRALQCPALDSYFHPPGTPAPGRGVGPGPGAGPGAGDGT |
| Interleukin-17 receptor D | Q8NFM7 | NP_001305793.1 | MESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTET TSCLLQNVSPGDYHIELVDDTNTTRKVMHYALKPVHSPWAGPIRAVAITVPLVVISAFATLFTVMCRKKQQENIYSHLDEESSESSTYTAALPRERLRPRPKVFLCYSSKDGQN HMNVVQCFAYFLQDFCGCEVALDLWEDFSLCREGQREWVIQKIHESGFIIVVCSKGMKYFVDRKNYKHKGGRGSGKGELFLVAVSAIAEKLRQAKQSSSAALSKFIAVVFD YSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVM CKPGPESDFCLKVEAAVLGATGPADSQHESQHGGLDQDGEARPALDGSAALQPLLHTVKAGSPSDMPRDSGIYDSSVPSSELSPLMEGLSTDQTETSSLTESVSSSGLGEE EPPALPSKLLSSGSCKADLGCRSYTDELHAVAPL |
| Interleukin 17 receptor E | Q8NFR9 | NP_001180309.1 | MGSSRLAALLLPLLLIVIDLSDSAGIGFRHLPHWNTRCPLASHTDDSFTGSSAYIPCRTWWALFSTKPWCVRVWHCSRCLCQHLLSGSGGLQRGLFHLLVQKSKSSTFKFYR RHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGG HTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWVYLEKVDLHPQ LCFKFSFGNSSHVECPHQTGSLTSWNVSMDTQAQQILHFSSRMHATFSAAWSLPGLGQDTLVPPVYTVSQARGSSPVSLDLIIPFLRPGCCVLHASLSSPGGEDAWLIGV GGSVPSGVAVRCPVCLEAPLVSGCLLQTPGALDPGTAGPPHPTGCCSGPHLPAPTVRPGPSAASAPPARGGLGGAAAPGGSAG |

FIG. 61

| Immunoglobulin superfamily | UniProt ID | RefSeq Accession | Amino Acid Sequence |
|---|---|---|---|
| Interleukin 1 receptor, type I | P14778 | NP_000868.1 | MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENE PNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSP ANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLT VIIVCSVFIYKIFKIDIVLWYRDSCYDFLPIKASDGKTYDAYILYPKTVGEGSTSDCDIFVFKVLPEVLEKQCGYKLFYGRDDYVGEDIVEVINENVKKSRRLIHLVRETSGFSWLGG SSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG |
| Interleukin 1 receptor, type II | P27930 | NP_001248348.1 | MLRLYLVIMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVC TTRNASYCDKMSIELRVFENTDAFLPFISYPQBLTLSTSGVLVCPDLSEFTRDKTDVKIQWVKDSLLLDKDNEKFLSVRGTTHLLVHDVALEDAGYYRCVLTFAHEGQQYNITRSI ELRIKKKEETIPVIISPLKTISASLGSRLTIPCKYFLGTGTPLTTMLWVTANDTHIESAYPGGRVTEGPRQ |
| Interleukin-1 receptor-like 1 | Q01638 | NP_001269337.1 | MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGK NANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF |
| Interleukin-1 receptor-like 2 | Q9HB29 | NP_003845.2 | MWSLLLCGLSIALPLSVTADGCKDIFMKNEILSASQPPFAFNCTFPPITSGEVSVTWYKNSSKIPVSKIIQSRIHQDETWILFLPMEWGDSGVYQCVIKGRDSCHRIHVNLTVFEK HWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKII YPKNHSIEVQLGTTLIVDCNVTDTKDNTNLRCWRVNNTLVDDYDESKRIREGVETHVSFREHNLYTVNITFLEVKMEDYGLPFMCHAGVSTAYIILQLPAPDFRAYLIGGLIA LVAVASVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGL LKNLSEEQJAVYSALIQDGMKVILIELEKIEDYTVMPESIQYIKQKHGAIRWHGDFTEQSQCMKTFWKTVRYHMPPRRCRPFPPVQLLQHTPCYRTAGPELGSRRKKCTLTTG |
| Interleukin-18 1 | Q13478 | NP_001269328.1 | MCNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMR IMTPEGKWHASKVLRIENIGESNLNVLYNCTVASTGGTDTKSFILVRKDMADIPGHVFTRGMIAVLILVAVVCLVTVCVIYRVDVLVFYRHLTRRDETLTDGKTYDAFVSYLKE CRPENGEEHTFAVEILPRVLEKHFGYKLCIFERDVVPGGAVVDEIHSLIEKSRRLIIVLSKSYMSNEVRYELESGLHEALVERKIKHLIEFTPVTDFTFLPQSLKLLKSHRVLKWKAD KSLSYNSRFWKNLLYLMPAKTVKPGRDEPEVLPVLSES |
| IL-1 receptor accessory protein | Q9NPH3 | NP_001116140.1 | MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNY TCMLRNTTYCSKVAFPLEVVQKDSCFNSPMKLPVHKLYIEYGIQRITCPNVDGYFPSSVKPTITWYMGCYKIQNFNNVIPEGMNLSFUALISNNGNYTCVVTYPENGRTFHLT RTLTVKVVGSPKNAVPPVIHSPNDHVVYEKEPGEELLIPCTVVFSFLMDSRNEVVWWTIDGKKPDDITIDVTINESISHSRTEDERTRTQLSIKKVTSEDLKRSYVCHARSAKGEVA KAAKVKQKVPAPRYTVELACGFGATVLLVVILIVVYHVYWWLEMVLFYRAHFGTDETILDGKEYDIYVSYARNAEEEEFVLLTLRGVLENEFGYKLCIFDRDSLPGGIVTDETLSFI QKSRRLLVVLSPNVVLQGTQALLELKAGLENMASRGNINVILVQYKAVKETKVVKELKRAKTVLTVIKWKGEKSKYPQGRFWKQLQVAMPVKKSPRRSSSDEQGLSYSSLKNV |
| IL-18 receptor accessory protein | O95256 | NP_003844.1 | MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHF LTPGVNNSSGYICRPKMIKSPYDVACCVKMILEVKPQTNASCEYSASHKQDLLLGSTGSISCPSLSCQSDAQSPAVTWYKNGKLLSVERSNRIVDEVYDYHQGTYVCDYTQS DTVSSWTVRAVVQVRTIVGDTKLKPDILDPVEDTLEVELGKPLTISCKARFGEERVFNPVIKVVYIKDSDLEWEVSVPEAKSIKSTLKDEIIERNIILEKVTQRDLRRKFVCFVQNSI GNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAP GGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLR ITSRIFQWKGLSRTETTGRSSQPKEW |

FIG. 61 (CONT.)

| | | |
|---|---|---|
| PDGFRα (platelet derived growth factor receptor alpha) | P16234 | NP_006197.1 | MGTSHPAFLVLGCLLTGLSLILCQLSPILPNENEKVVQLNSSFSLRCFGESEVSWQYPMSEEESSDVEIRNEENNSGLFVTVLEVSSASAAHTGLYTCYNHTQTEENELEGR HIYIYVPDPDVAFVPLGMTDYLVIVEDDDSAIPCRTTDPETPVTLHNSEGVVPASYDSRQGFNGTFTVGPYICEATVKGKKFQTIPFNVYALKATSELDLEMEALKTVYKSGETI VVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPP RISWLKNNLTLIENLTEITTDVEKIQEIRYRSKLKLIRAKEEDSGHYTIVAQNEDAVKSYTFELLTQVPSSILDVDDHHGSTGGQTVRCTAEGTPLPDIEWMICKDIKKCNNETS WTHLANNVSNIITEIHSRDRSTVEGRVTFAKVEETIAVRCLAKNLLGAENRELKLVAPTLRSELTVAAAVLVLLVIVIISLIVLVVVWKQKPRYEIRWRVIESISPDGHEYIYVDPMQ LPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDS FLSHHPEKPKKELDIFGLNPADESTRSYVVLSFENNGDYMDMKQADTTQYVPMLERKEVSKYSDIQRSLYDRPASYKKKSMLDSEVKNLLSDDNSEGLTLLDLLSFTYQVARG MEFLASKNCVHRDLAARNVLLAQGKIVKICDFGLARDIMHDSNYVVSKGSTFLPVKWMAPESIFDNLYTTLSDVWSYGILLWEIFSLGGTPYPGMMVDSTFYNKIKSGYRMA KPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIPLPDIDPVPE EEDLGKRNRHSSQTSEESAIETGSSSSTFIKREDETIEDIDMMDDIGIDSSDLVEDSFL |
| PDGFRβ (platelet derived growth factor receptor beta) | P09619 | NP_002600.1 | MRLPGAMPALALKGELLLLSLLLLLEPQISQGLVTPPGPELVLNVSSTFVLTCSGSAPVVWERMSQEPPQEMAKAQDGTFSSVLTLTNLTGLDTGEYFCTHNDSRGLETDER KRLYIFVPDPTVGFLPNDAEELFIFLTEITEITPCRVTDPQLVVTLHEKKGDVALPVPYDHQRGFSGIFEDRSYICKTTIGDREVDSDAYYVYRLQVSSINVSVNAVQTVVRQGE NITLMCIVIGNEVVNFEWTYPRKESGRLVEPVTDFLLDMPYHIRSILHIPSAELEDSGTYTCNVTESVNDHQDEKAINITVVESGVRLLGEVGTLQFAELHRSRTLQVFEAYP PPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKR CPRELPPTLLGNSSEEESQLETNVTYWEEEQEFEVVSTLRLQHVDRPLSVRCTLRNAVGQDTQEVIVVPHSLPFKVVSIAILALVLTIISLIILIMLWQKKPRYERWKVIESVSS DGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTGGPIYIITEYCR YGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINES PVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELP MNEQFYNAIKRGYRMAQPAHASDEIYEIMQKCWEEKFEIRPPFSQLLVLLIERLLGEGYKKKYQQVDEEFLRSDHPAILRSQARLPGFHGLRSPLDTSSVLYTAVQPNEGDND YIIPLPDPKPEVADEGPLEGSPSLASSTLNEVNTSSTISCDSPLEPQDEPEPEPQLELQVEPEPELEQLPDSGCPAPRAEAEDSFL |
| KIT proto-oncogene receptor tyrosine kinase | P10721 | NP_002213.1 | MRGARGAWDFLCVLLLLLRVQTGSSQPSVSPGEPSPSSIHPGKSDLVRVGDEIRLLCTDPGFVKWTFEILDETNENKQNEWITEKAEATNTGKYTCTNKHGLSNSIYVFVRD PAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEF TVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFP KPEHQQWIYMNRTFTDKWEDYPKSENESNIRYVSELHLTRLKGTEGGTYTFLVSNSDVNAAIAFNVVYNTKPEILTYDRLVNGMLQCVAAGFPEPTIDWYFCPGTEQRCSA SVLPVDVQTLNSSGPPFGKLVVQSSIDSSAFKHNGTVECKAYNDVGKTSAYFNFAFKGNNKEQIHPHTLFTPLLIGFVIVAGMMCIIVMILTYKYLQKPMYEVQWKVVEEING NNYVVIDPTQLPYDHKWEFPRNRLSFGKTLGAAGFGKVVEATAHGLSHSQATMLIKPSAHLTEREALMSELKVLSYLGNHMNIVNLLGACTIGGPTLVITEYCCYGD LLNFLRRKRDSFICSKQEDHAEAAIYKNLLHSKESSCSDSTNEYMDMKPGYSYVVPTKADKRRSVRIGSYIERDVTPAIMEDDELALDLEDLLSFSYQVAKGMAFLASKNCIHR DLAARNILLTHGRITKICDFGLARDIMNDSNYIVKGNARLPVKWMAPESIFNCVYTFESDVWSYGIFLWELFSLGSSPYPGMPVDSKFYKMIKEGFRMLSPEHAPAEMYDIM KTCWDADPLKRPTFKQIVQLIEKQISESTNHIYSNLANCSPNRQKPVVDHSVRINSVGSTASSSQPLLVHDDV |
| CSFR (colony stimulating factor 1 receptor) | P07333 | NP_001275634.1 | MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVL AQEVVVFEDQDALLPCLLTDPVLEAGVSLVRVRGRPLMRHTNYSFSPWHGFTIHRAKFIQSQDYQCSALMGGRKVMSIRLKVQKVPGPPALTLVPAELVIRGEAAQIVC SASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQG FNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQ VLQVWDDPYPEVLSQEPFHKVTFQSLLVETLEHNQTYECRAHNSVGSGSWAFIPISAGAHTHPPDEFLFTPVVACMSIMALLLLLLLLLYKYKQKPKYQVRWKIIESYEG NSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYG DLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVA ARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQA CWALEPTTHRPTFQQICSFLQEQAQEDRRERDYTNLPSSSRSGGSSGSSSSELEEESSSSEHLTCCEQGDIAQPLLQPNNYQFC |

FIG. 62

| Tumor necrosis factor receptor family | UniProt ID | RefSeq Accession | Amino Acid Sequence |
|---|---|---|---|
| TNFR1 (tumor necrosis factor receptor 1 / TNFRSF1A) | P19438 | NP_001056.1 | MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPVQGADPILATALASDPIPNPLQKWEDSAHKPQSLLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR |
| TNFR2 (tumor necrosis factor receptor 2 / TNFRSF1B) | P20333 | NP_001057.1 | MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS |
| lymphotoxin β receptor / TNFRSF3 | P36941 | NP_001257961.1 | MEATGISLASQLKVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCEILLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFFDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD |
| OX40 / TNFRSF4 | P43489 | NP_003318.1 | MCVGARRLGRGPCAALLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI |
| CD40 / TNFRSF5 | P25942 | NP_001241.1 | MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ |
| Fas / TNFRSF6 | P25445 | NP_000034.1 | MLGIWTLLPLVLTSVARLSSKSVNAQVTDINSKGLELRKTVTTVETQNLEGLHHDGQFCHKCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLSNTKCKEEGSRSNLGWLCLLLLPIPLIVWVKRKEVQKTCRKHRKEMQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV |
| decoy receptor 3 / TNFRSF6B | O95407 | NP_003814.1 | MRALEGPGLSLLCLLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH |
| CD27 / TNFRSF7 | P26842 | NP_001233.1 | MARPHPWWLCVLGTVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP |
| CD30 / TNFRSF8 | P28908 | NP_001243.3 | MRVLLAALGLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSCPAGMIVKPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTTPENGEAPASTSPTQSLLVDSQASKTLPIPTSAPVALSSTGKPVLDAGPVLFWVIVLVLVVVGSSAFLLCHRRACKRRIRQKLHLCPVPQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEGKEDPLPTAASGK |
| 4-1BB / TNFRSF9 | Q07011 | NP_001552.2 | MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFTLRFSVVKRGRKKLLYIFKQPFMRPVQTTQEEDGCSCRFPEEEEGGCEL |

FIG. 62 (CONT.)

| | | | |
|---|---|---|---|
| DR4 (death receptor 4 / TNFRSF10A) | O00220 | NP_003835.3 | MAPPPARVHLGAFLAVTPNPGSAASGTEAAAATPSKVWGSSAGRIEPRGGGRGALPTSMGQHGPSARARAGRAPGCPRPAREASPRLRVHKTFKFVVVGVLLQVPSSAA TIKLHDQSIGTOQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVK DCTPWSDIECVHKESGNGHNIWVILVVTLVPLLLVAVLIVCCGISGCGGDPKCMDRVCFWRLGLLRGPGAEDNAHNEILSNADSLSTFVSEQQMESQEPADLTGVTVQS PGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEER HAREKIQDLLVDSGKFYMLEDGTGSAVSLE |
| DR5 (death receptor 5 / TNFRSF10B) | O14763 | NP_003833.4 | MEQRGQNAPAASGARKRHGPGPREARGARPGPRVPKTLVLVAAVLLLVSAESALITQQDLAPQORAAPQQKRSSPESEGLCPPGHHISEDGRDCLSCKYGQDYSTHWND LLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIGVTVAAV VLIVAVFVCKSLLWKKVLPYLKGICSGGGGDPERVDRSSQRPGAEDNVLNEVSILQPTQVPEQEMEVQEPAEPTGVNMLSPGESEHLLEPAEAERSQRRRLLVPANEGDPT ETLRQCFDDFADLVPFDSWEPLMRKLGLMDNEIKVAKAEAAGHRDTLYTMLKWVNKTGRDASVHTLLDALETLGERLAKQKIEDHLLSSGKFMYLEGNADSAMS |
| decoy receptor 1 / TNFRSF10C | O14798 | NP_003832.2 | MARIPKTLKFVVVIVAVLLPVLAYSATTARQEEVPQQTVAPQQRHSFKGEECPAGSHRSEHTGACNPCTEGVDYTNASNNEPSCPCTVCKSDQKHKSSCTMTRDTVCQ CKEGTFRNENSPEMCRKCSRCPSGEVQVSNCTSWDDIQCVEEFGANATVETPAAAEETMNTSPGTPAPAAEETMTTSPGTPAPAAEETMTTSPGT PAPAAEETMTTSPGTPASSHYLSCTIVGIIVLVLLIVFV |
| decoy receptor 2 / TNFRSF10D | Q9UBN6 | NP_003831.2 | MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNN LPSCLLCTVCKSGQTNKSSCTTTRDTVCQCEKGSFQDKNSPEMCRTCRTGCPRGMVKVSNCTPRSDIRCKNESAASSTGKTPAAEETVTTILGMLASPYHYLIIVVLIHLAVV VVGFSCRKFISYLKGICSGGGGDPERVHRVLFRRRSCPSRVPGAEDNARNETLSNRYLQPTQVSEQEIQGQELAELTGVTVELPEEPQRLLEQAEAEGCQRRRLLVPVNDAD SADISTLLDASATLEEGHAKETIODQLVGSEKLFYEDEAGSATSCL |
| RANK (receptor activator of NF-kappa B / TNFRSF11A) | Q9Y6Q6 | NP_001258 78.1 | MAPRARRRPLFALLLLCALLARLQVALQAJAPPCTSEKHYEHLGRCCNKCEPGKYMSSKCTTSDSVCLPCGPDEYLDSWNEEDKCLLHKVCDTGKALVAVVAGNSTTPRRC ACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIIILLFASVA LVAAIIFGVCYRKKGKALTANLWHWINEACGRLSGDKEM |
| OPG (osteoprote rin / TNFRSF11B) | O00300 | NP_002537.3 | MNNLLCCALVFLDISIKWTTQETFPPKYLHYDEETSHQLLCDKCPPGTYLKQHCTAKWKTVCAPCPDHYTDSWHTSDECLYCSPVCKELQYVKQECNRTHNRVCECKEGR YLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFREAVPTKFTPNWLSVLVD NLPGTKVNAESVERIRKRQHSSQEQTFQLLKLWKHQNKDQDIVKKIIQDIDLCENSVQRHIGHANLITFEQLRSLMESLPGKKVGAEDIEKTIKACKPSDQILKLLSLWRIKNGDQ DTLKGLMHALKHSKTYHFPKTVTQSLKKTIRFLHSFTMYKLYQKLFLEMIGNQVQSVKISCL |
| DR3 (death receptor 3 / TNFRSF25) | Q93038 | NP_001034 75 3.1 | MEQRPRGCAAVAAALLVLLGARAQGTRSPRCDCAGDFHKKIGLFCCRGCPAGHYLKAPCTEPCGNSTCLVCPQDTFLAWENHHNSECARCQACDEQASQVALENCSA VADTRCGCKPGWFVECQVSQCVSSSPFYCQPCLDCGALHRHTRLLCSRRDTDCGTCLPGFYEHGDGCVSCPT |
| TWEAK receptor / TNFRSF1 2A | Q9NP84 | NP_057723.1 | MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTT PIEETGGEGCPAVALIQ |
| TACI / TNFRSF13B | O14836 | NP_036584.1 | MSGLGRSRRGGRSRVDQEERFPQGLWTGVAMRSCPEEQYWDPLLGTCMSCKTICNHQSQRTCAAFCRSLSCRKEOGKFYDHLLRDCISCASICGQHPKQCAYFCENKLRS PVNLPPELRRQRSGEVENNSDNGSRYQGLEHRGSEASPALPGLKLSADQVALVYSTLGLCLCAVLCCFLVAVACFLVKKRGDPCSCQPRSRPQSPAKSSQDHAMEAGSPVST SPEPVETCSFCFPECERAPTQESAVTPGTPDPTCAGRWGCHTRTTVLQPCPHIPDSGLGIVCVPAQEGGPGA |
| BAFF-R (BAFF receptor / TNFRSF1 3C) | Q96RJ3 | NP_443177.1 | MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGA SSAEAPDGDKDAPEPLDKVIILSPGISDATAPAWPPPGEDPGTTPPGHSVPVPATELGSTELVTTKTAGPEQQ |
| HVEM (herpes virus entry mediator / TNFRSF1 4) | Q92956 | NP_003811.2 | MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNC SRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVG LIICVKRRKPRGDVVKVIVSVQRKRQEAEGEATVIEALQAPPDVTTVAVEETIPSFTGRSPNH |
| nerve growth factor receptor / TNFRSF1 6 | P08138 | NP_002498.1 | MGAGATGRAMDGPRLLLLLLLGVSLLGGAKEACPTGLYTHSGECCKACNLGEGVAQPCGANQTVCEPCLDSVTFSDVVSATEPCKPCTECVGLQSMSAPCVEADDAVCRC AYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPAPPE QDLIASTVAGVVTTVMGSSQPVVTRGTTDNLIPVYCSILAAVVVGLVAYIAFKRWNSCKQKGANSRPVNQTPPPEGEKLHSDSGISVDSQSLHDQQPHTQTASGQALK GDGGLYSSLPPAKREEVEKLLNGSAGDTWRHLAGELGYQPEHIDSFTHEACPVRALLASWATQDSATLDALLAALRRIQRADLVESLCSESTATSPV |

FIG. 62 (CONT.)

| | | |
|---|---|---|
| BCMA (B cell maturation antigen / TNFRSF17) | Q02223 | NP_001183.2 | MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIIL PRGLEYTVEECTCEDCIKSKPKVDSDHCFPLPAMEEGATILVTTKTNDVCKSLPAALSATEIEKSISAR |
| GITR (glucocorticoi d-induced TNF receptor / TNFRSF1 8) | Q9Y5U5 | NP_004186.1 | MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFS FGFQCIDCASGTFSGGHEGHCKPWTDCTQFGFLTVFPGNKTHNAVCVPGSPPAEPLGWLTVVLLAVAACVLLLTSAQLGLHWQLRSQCMWPRETQLLLEVPPSTEDARS CQFPEEEERGERSAEEKGRLGDLWV |
| TAJ (toxicity and JNK inducer / TNFRSF19) | Q9NS68 | NP_001191387.1 | MALKVILLEQEKTFFTLLVLLGYLSCKVTCESGDCRQQEFRDRSGNCVPCNQCGPGMELSKECGFYGEDAQCVTCRLHRFKEDWGFQKCKPCLDCAVVNRFQKANCSATS DAICGDCLPGFYRTKLVGFQDMECVPCGDPPPYEPHCASKVNLVKIASTASSPRDTALAAVICSALATVLLALILCVIYCKRQFMEKKPSWSLRSQDIQYNGSELSCFDRP QLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGED IHSLNPELESSTSLDSNSSQDLVGGAVPVQSHSENFTAATDLSRYNNTLVESASTQDALTMRSQLDQESGAVIHPATQTSLQEA |
| RELT / TNFRSF19L | Q96924 | NP_116260.2 | MKPSLLCRPLSCFLMLLPWPLATLTSTTLWQCPPGPEEPDLPGQGTLCRPCPPGTFSAAWGSSPCQPHARCSLWRRLEAQVGMATRDTLCGDCWPGWFGPWGVPRVP CQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGSGINPAYRT EDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVP KAGAKAGRQGEITILSVGRFRVARIPEQRTSSMVSEVKTITEAGPSWGDLPDSPQPGIPPEQQALLGSGGSRTKWLKPPAENKAEENRYVVRLSESNLVI |
| DR6 (death receptor 6 / TNFRSF21) | O75509 | NP_052267.1 | MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCP WPMIEKLPCAALTDRECTCPPGMFQSNATCAPHTVCPVGWGVRKKGTETEDVRCKQCARGTFSDVPSSVMKCKAYTDCLSQNLVIKPGTKETDNVCGTLPSFSSSTSPSP GTAIFPRPEHMETHEVPSSTYVPKGMNSTESNSSASVRPKVLSSIQEGTVPDNTSSARGKEDVNKTLPNLQVVNHQQGPHHRHLKLLPSMEATGGEKSSTPIKGPKRGHPR QNLHKHFDINEHLPWMVIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSN GYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTS SGSSALSRNGSFHTKEKDTVLRQVRLDPCDLQPIFDDMLHFLNPEELRVIEEIPQAEDKLDRLFEIIGVKSQEASQTLLDSVYSHLPDLL |
| TNFRSF22 | Q9ER62 | NP_001298074.1 | MFGFFCSLVSSLSRWFLWRRLLLLLLLLLNLPLQVKFAMLLEHSFKCPAGEYWSKDVCCKNCSAGTFVKAPCEIPHTQGQCEKCHPGTFTEKDNYLDACILCSTCDKDQEMV ADCSATSDRKCQCRTGLYYYDPKFPESCRPCTKCPQGIPVLQECNSTANTVCSSSVSNPRNRLFLLLSPLSVLIVSVVVFRIIRR |
| TNFRSF23 | Q9ER63 | NP_077252.2 | MVTFSHVSSLSHWFLLLLLLLNLFLPVIFAMPESYSFNCPDGEYQSNDVCCKTCPSGTFVKAPCKIPHTQGQCEKCHPGTFTGKDNGLHDCELCSTCDKDQNMVADCSATSD RKCECQIGLYYYDPKFPESCRPCTKCPQGIPVLQECNSTANTVCSSSVSNPRNWLFLLMLIVFCI |
| ectodysplasin A2 isoform receptor / TNFRS27 | Q9HAV5 | NP_001186616.1 | MDCQENEYWDQWGRCVTCQRCGPGQELSKDCGYGEGDAYCTACPPRRYKSSWGHHRCQSCITCAVINRVQKVNCTATSNAVCGDCLPRFYRKTRIGGLQDQECIPCT KQTPTSEVQCAFQLSLVEADAPTVPPQEATLVALVSSLLVVFTLAFLGLFFLYCKQFFNRHCQRGGLLQFEADKTAKEESLFVPPSKETSAESQVSENIFQTQPLNPILEDDCSS TSGFPTQESFTMASCTSESHSHWVHSPIECTELDLQKFSSSASYTGAETLGGNTVESTGDRLELNVPFEVPSP |
| ectodysplasin 1, anhidrotic receptor | Q9UNE0 | NP_071731.1 | MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMEN DAECGPCLPGYYMLENRPRNIYGMVCYSCLLAPPNTKECVGATSGASANFPGTSGSSTLSPFQHAHKELSGQHLATALIAMSTIFIMAIAIVLIIMFYILKTKPSAPACCTSH PGKSVEAQVSKDEEKKEAPDNVVMFSEKDEFEKLTATPAKPTKSENDASSENEQLLSRVDSDEEPAPDKQGSPELCLLSLVHLAREKSATSNKSAGIQSRRKKILDVYANVCG VVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS |

FIG. 63

| Chemokine receptors | UniProt ID | RefSeq Accession | Amino Acid Sequence |
|---|---|---|---|
| CCR1 | P32246 | NP_001286.1 | METPNTTEDYDTTTEFDYGDATPCQKVNERAFGAQLLPPLYSLVFVIGLVGNILVVLVVQKRLKNMTSIYLLNLAISDLLFLTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVPLLVMHCYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF |
| CCR2 | P41597 | NP_001116513.2 | MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVVYCGPYFPRGWNNFHTIMRNILGLVLPLLIMVICYSGILKTLLRCRNEKKRHRAVRVIFTIMIVYFLFWTPYNIVLLLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA |
| CCR3 | P51677 | NP_001828.1 | MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIYTETEELFEETLCSALYPEDTVYSWRHFHTLRMTIFCLVLPLLVMAICYTGIIKTLLRCPSKKKYKAIRLIFVIMAVFFIFWTPYNVAILLSSYQSLFGNDCERSKHLDLVMLVTEVIAYSHCCMNPVIYAFVGERFRKYLRHFFHRHLLMHLGRYIPFLPSEKLERTSSVSPSTAEPELSIVF |
| CCR4 | P51679 | NP_054499.1 | MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINLGLVIPLGIMLFCYSMIIRTLQHCKNEKKNKAVKMIFAVVVLFLGFWTPYNIVLFLETLVELVLQDCTFERYLDYAIQATETLAFVHCCLNPIIYFFLGEKFRKYLQLFKTCRGLFVLCQYCGLLQYSADTPSSSYTQSTMDHDLHDAL |
| CCR5 | P51681 | NP_000570.1 | MDYQVSSPYDINYYTSEPCQKINVKQIAARLLPPLYSLVFIFGFVGNMLVILILINCKKRLKSMTDIYLLNLAISDLFLLTVPFWAHYAAAQWDFGNTMCQLLTGLYFIGFFSGIFFIILLTIDRYLAIVHAVFALKARTVTFGVVTSVITWVVAVFASLPGIIFTRSQKEGLHYTCSSHPYSQYQFWKNFQTLKIVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL |
| CCR6 | P51684 | NP_004358.2 | MSGESMNFSDVFDSSEDYFVSVNTSYYSVSDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKICLVVWGLSVIISSSTFVFNQKYNTQGSDVCEPKYQTVSEPIRWKLLMLGLELFGFFIPLMFMHICFYEVKTLVQAQNSKRHKAIRVIIAVVLVFLACQIPHNMVLLVTAANLGKMNNRSCQSEKIGYTKTVTEVLAFLHCCLNPVLYAFIGQKFRNYFLKILKDLWCVRRKYKSSGFSCAGRYSENISRQTSETADNDNASSFTM |
| CCR7 | P32248 | NP_0012886413.1 | MYSICFVGLLGNGLVVLTYIYFKRLKTMTDTYLLNLAVADILFLLTLPFWAYSAAKSWVFGVHFCKLIFAIYKMSFFSGMLLLCISIDRYVAIVQAVSAHRHRARVLLISKLSCVGIWILATVLSIPELLYSDLQRSSEEQAMRCSLITEHVEAFITQVAQMVIGFLVPLLAMSFCYLVIIRTLLQARNFERNKAIKVIIAVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP |
| CCR8 | P51685 | NP_005192.1 | MDYTLDLSVTTVTDYYYPDIFSSPCDAELIQITNGKLLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQJFNVLGRQMPRESCEKSSSCCQQHSSRSSVDYIL |
| CCR9 | P51686 | NP_0012432918.1 | MADDYGSESTSSMEDYVNFNFTDFYCEKNNVRQFASHFLPPLYWLVFIVGALGNSLVILVLYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCPEILYSQIKEESGIAICTMVVPSDESTLKSAVLTKVILGFFLPFVVMACCYTIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL |
| CCR10 | P46092 | NP_057686.2 | MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYLAIVRALPAGPRPSTPGRAHLVSVIVWLLSLLLALPALLFSQDGQREGQRRCRLIPPEGLTQTVKGASAVAQVALGFALPLGVMVACYALLGRTILAARGPERRALRVVVALVAAFVVLQLPYSLALLLDTADLLAARERSCPASKRKDVALLVTSGLALARCGLNPVLYAFLGLRFRQDLRRLLRGGSCPSGPQPRRGC |
| CXCR1 (IL8Ra) | P25024 | NP_000625.1 | MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFVPLVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL |

FIG. 63 (CONT.)

| | | |
|---|---|---|
| CXCR2 (IL8Rb) | P25025 | NP_001116177.1 | MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL |
| CXCR3 | P49682 | NP_001139269.1 | MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHLLAVLLVSRGQRRLRAMRLVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL |
| CXCR4 | P61073 | NP_001008540.1 | MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVVGVWIPALLLTIPDFIFANVSEADDRYICDRFYPNDLWVVVFQFQHIMVGLILPGIVILSCYCIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS |
| CXCR5 | P32302 | NP_001707.1 | MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHTCGTIWLVGFLLALPEILFAKVSQGHHNNSLPRCTFSQENQAETHAWFTSRFLYHVAGFLLPMLVMGWCVVGVHRLRLQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF |
| CXCR6 | O00574 | NP_006555.1 | MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL |
| CX3CR1 | P49238 | NP_001116464.2.1 | MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL |

FIG. 64

| TGF beta receptors | UniProt ID | RefSeq Accession | Amino Acid Sequence |
|---|---|---|---|
| transforming growth factor beta, receptor type I (TGFBR1 (ALK5)) | P36897 | NP_004603.1 | MEAAVAAPRPRLLLLVLAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM |
| transforming growth factor beta, receptor type II (TGFBR2 (MFS2)) | P37173 | NP_003233.4 | MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK |
| transforming growth factor beta, receptor type III (TGFBR3 (β-Glycan)) | Q03167 | NP_003234.2 | MTSHYVIAIFALMSSCLATAGEPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLINWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLIJLIKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPRGGEGQNGGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIENICPKDESVKFYSPKRVHFPIPQADMDKKRFSVFKPVFNTSLLFLQCELTLCTRMEKHPQKLPKCVPPDEACTSLLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSTA |

FIG. 65

| Protein | RefSeq | UniProt | Amino Acid Sequence |
|---|---|---|---|
| MERTK | NP_006334 | Q12866 | MGPAPLPLLLGLFLPALWRRAITEAREEAKPYPLFPGPEPGSLQTDHTPLSLPHASGYQPALMFSPTQPGRPHTGNVAIPQVTSVESKPLPPLAFKHTVGHILSEHKGVKFNCSISV PNIYQDTTISWWKDGKELLGAHHAITQFYPDDEVTAIIASFSITSVQRSDNGSYICKMKINNEEIVSDPYIEVQGLPHFTKQPESMNVTRNTAFNLTCQAVGPPEPVNIFWVQNSS RVNEQPEKSPSVLTVPGLTEMAVFSCEAHNDKGLTVSKGVQJINKAIPSPPTEVSIRNSTAHSILSWVPGFDGYSPFRNCSIQVKEADPLSNGSVMIFNTSALPHLYQIKQLQALANY SIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGV GPFSDPVKIFIPAHGWVDYAPSSTPAPGNADPVLIIFGCCFGLIGLILYISLAIRKRVQETKFGNAFTEEDSELVVNYIAKKSFCRRAIELTLHSLGVSEELQNKLEDVVIDRNLILGKIL GEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALG MEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQ PEDCLDELYEIMYSCWRTDPLDRPTFSVLRLQLEKLLESLPDVRNQADVIYVNTQLLESSEGLAQGSTLAPLDLNDPDSIIASCTPRAAISVVTAEVHDSKPHEGRYILNGGSEEWED LTSAPSAAVTAEKNSVLPGERLVRNGVSWSHSSMLPLGSSLPDELLFADDSSEGSEVLM |
| LMTK3 | NP_001073903 | A0A0A0MQW5 | MRQVLWLCNVCVTARETRHHLHLPAILDKMPAPGALILLAAVSASGCLASPAHPDGFALGRAPLAPPYAVVLISCSGLLAFILLLTCLCCKRGDVGFKEFENPEGEDCSGEYTPPAE ETSSSQSLPDVYILPLAEVSLPMPAPQPSHSDMTTPLGLSRQHLSYLQEIGSGWFGKVILGEIFSDYTPAQVVKELRASAGPLEQRKFISEAQPYRSLQHPNVLQCLGLCVETLPFLLI MEFCQLGDLKRYLRAQRPPEGLSPELPPRDLRTLQRMGLEIARGLAHLHSHNYVHSDLARNCLLTSDLTVRIGDYGLAHSNYKEDYLTPERLWIPLRWAAPELLGELHGTFMVV DQSRESNIWSLGVTLWELFEFGACPYRHLSDEEVLAFVVRQQHVKLARPRLKLPYADYWYDILQSCWRPPAQRPSASDLQLTYLLSERPPRPPPPPRDGPCWPWPPAH SAPRPGTLSSPFFLLDGFPGADPDDVLTVTESSRGLNLECLWEKARRGAGRGGGAPAWQPASAPPAPHANPSNPFYEALSTPSVLPVISARSPSVSEYYIRLEEHGSPPEPLFPND WDPLDPGVPAPQAPQAPSEVPQLVSETWASPLFPAPRPFPAQSSASGSFLLSGWDPEGRGAGETLAGIDPAEVLGERGTAPWVEEEEEEESSPGEDSSSLGGGPSRRGPLPCP LCSREGACSCLPLERGDAVAGWGHPALGCPHPPEDDSSLRAERGSLADLPMAPPASAPPEFLDPLMGAAAPQYPGRGPPPAPADPAASPDPPSAVASPGSGLS SPGPKPGDSGYETETPFSPEGAPFPGGGAAEEEGVPRPRAPPEPPDPGAPRPPPDPGPLPGPREKPTFVVQVSTEQLLMSLREDVTRNLLGEKGATARETGPRKAGRGPGNREK VPGLNRDPTVLGNGKQAPSLSLPVNGVTVLENGDQRAPGIEEKAAAENGALGSPEREEKVLENGELTPRREEKALENGELRSPEAGEKVLVNGGLTPPKSEDKVSENGGLRFPRNT ERPPETGPWRAPGPWEKTPESWGPAPTIGEPAPETSLERAPAPSAVVSSRNGGETAPGLPGAPKNGTLEPGTERRAPETGGAPRAPGAGRLDLGSGGRAPVGTGTAPGGGPG SGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPF PGPGPRRPPWEGADAGAAGGEAGGAGAPGPAEEDGEDEDEDEEEAAAPGAAAGPRGPRARAAPVPVVVSSADADAARPLRGLLKSPRGADEPEDSELERKRKMVSFH GDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN |
| CSF1R | NP_001275634 | P07333 | MGPGVLLLLLVLATAWHGQGIPVIEPSVPELVVKPGATVTLRCVGNSGVEWDGPPSPHWTLYSDGSSSILSTNNATFQNTGTYRCTEPGDPLGGSAAIHLYVKDPARPWNVLAQE VVVFEDQDALLPCLLTDPVLEAGVSLVRVRGRPLMRHTNVSFSPWHGFTIHRAKFIQSODYQCSALMGGRKVMSISIRLKVQKVIPGPPALTLVPAELVRIRGEAAQVCSASSVDV NFDVFLQHNNTRKLAIPQQSDFHNNRYQKVLTLNLDQVFQHAGNYSCVASNVQGKHSTSMFFRVVESAYLNLSEQNLIQEVTVGEGLNLKVMVEAYPGLQGFNWTYLGPFSD HQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYEVLS QEPFHKVTVQSLLTVETLEHNQTYECRAHNSVGSGSWAFIPISAGAHTHPPDEFLFTPVVVACMSIMALLLLLLLLLYKYKQKPKYQVRWKIIESYEGNSYTFIDPTQLPYNEKWEF PRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLPGQ DPEGGVDYKNIHLEKKYVRRDSGFSSQGVDTYVEMRPVSTSNDSFSEQDLDKEDGRPLELRDLLHFSSQVAQGMAFLASKNCIHRDVAARNVLLTNGHVAKIGDFGLARDIMN DSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRE RDYTNLPSSSRSGGSGSSSSELEEESSSEHLTCCEQGDIAQPLLQPNNYQFC |
| EGFR | NP_005219 | P00533 | MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYA LAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDC CHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGE FKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNK NLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQC AHYIDGPHCVKTCPAGVMGENNTLVWKYADAGHVCHLCHPNCTYGCTGPGLEGCPTNGPKIPSIATGMVGALLLLVLALGIGLFMRRRHIVRKRTLRRLLQERELVEPLTPSGE APNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLN WCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGER LPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVA CIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSH QISLDNPDYQQDFFPKEAKPNGIFKGSTAENAEYLRVAPQSSEFIGA |

FIG. 65 (CONT.)

| | | |
|---|---|---|
| EPHA2 | NP_004422 | P29317 | MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFP GGASSCKETFNLYAESDLDYGTNFQKRLFTKIDTIAPDEITVSSDFEARHVKLNVEERSVGPLTRKGFYLAFQDIGACVALLSVRVYYKCPELLQGLAHFPETIAGSDAPSLATVAGT CVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGA KVELRWTPPQQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVWSIP PPCQDSRVWKYEVTYRKKGDSNSYNVRRTEGFSVTLDDLAPDTTYLVQVQALTQESQGAGSKVHEFQTLSPEGSGNLAVGGVAVGVVLLLVLAGVGFFIHRRKNQRARQCSPED VYFSKSEQLKPLKTYVDPHTYEDPNQAVLKFTTEIHPSCVTRQKVIGAGEFGEVYKGMLKTSSGKEVPVAIKTLKAGYTEKQRVDFLGEAGIMGQFSHHNIRLEGVISKYKPMMII TEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIV MMEVMTYGERPYWELSNHEVMKAINDGRRLPTPMDCPSAIYQLMMQCWQQERARRPKFADIVSILDKLIRAPDSLKTLADFDPRVSIRLPSTSGSEGVPFRTVSEWLESIKMQQ YTEHFMAAGYTAIEKVVQMTNDDIKRIGVRLPGHQKRIAYSLLGLKDQVNTVGIPI |
| EPHA1 | NP_005223 | P21709 | MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPG GAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEV AGTCLPHARASPRPSGAPRMHCSPDGEWLVPGRCHCEPGYEEGGSGEACVACPGSGYRMDMDTPHCLTCPQQSTAESEGATICTCESGHYRAPGEGPQVACTGPPSAPRNL SFSASGTQLSLRWEPPADTGGRODVRYSVRCSQCQGTAQDGGPCCPCGVGHFSPGARGLITPAVHVNGLGEPYANYTFNVEAQNGVSGLGSSGHASTSVSISMGHAESLSGLS RLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLGILVFRSR RAQRQRQQRQRDRATDVDREDKLWLKPVVDLQAYEDPAQGALDFTRELDPAWLMVDTVIGEGEFGEVYRGTLRLPSQDCKTVAIKTLKDTSPGGQWWNFLREATIMGQFSH PHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAI AHRIFTTASDVWSFGIVMWEVLSFGDKPYGEMSNQEVMKSIEDGYRLPPPVDCPAPLYELMKNCWAYDRARRPIHFQKLQAHLEQLLANPHSLRTIANFDPRMTLRLPSLSGSD GIPYRTVSEWLESIRMKRYILHFSAGLDTMECVLELTAEDLTQMGITLPGHQKRLCSIQGFKD |
| EPHA3 | NP_005224 | P29320 | MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCK ETFNLYMESDDDHGVKFREHQFTKIDTIAADESFTQMDLGDRILKLNTEIREVGPVNKKGFYLAFQDVGACVALVSVRVFFKKCPFTVKNLAMFPDTVPMDSQSLVEVRGSCVN NSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDW SWPLDTGGRKDVTFNHCKKCGWNIKQCEPCSPNVRFLPRQFGLTNTTVTVTDLLAHTNYTFEIDAVNGVSELSSPPRQFAAVSITTNQAAPSPVLTIKKDRTSRNSJSLSWQEPEHP NGIILDYEVKYYEKQEQETSYTILRARGTNVTISSLKPDTIVFQIRARTAAGYGTMSRKFEFETSPDSFSISGESSQVVMIAISAAVAIILLTVVIYVLIGRFCGYKSKHGADEKRLHFGNG HLKLPGLRTYVDPHTYEDPTQAVHEFAKELDATNISIDKVQAGEFGEVCSGRLKLPSKKEISVAIKTLKVGYTEKQRRDFLGEASIMGQFDHPNIIRLEGVVTKSKPVMIVTEYMEN GSLDSFLRKHDAQFTVIQLVGMLRGIASGMKYLSDMGYVHRDLAARNILINSNLVCKVSDFGLSRVLEDDPEAAYTTRGGKIPIRWTAPEAIAYRKFTSASDVWSFGIVLMEVMSY GERPYWEMSNQDVIKAVDEGYRLPPPMDCPAALYQLMLDCWQKDRNNRPKFEQIVSILDKLIRNPGSLKIHTSAAARPSNLLLDQSNVDITTFRTTGDWLNGVWTAHCKEFTGV EYSSCDTIAKISTDDMKKVGVTVVGPQKKIISSIKALETQSKNGPVPV |
| EPHA4 | NP_001291465 | P54764 | MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVM GTCKETFNLYYYESDNDKERFIRENQFVKIDTIAADESFTQVDIGDRIMKLNTEIRDVGPLSKKGFYLAFQDVGACIALVSVRFVKKCPLTVRNLAQFPDTITGADTSSLVEVRGSCV NNSEEDVPKMYCGADGEWLVPIGNCLCNAGHEERSGECCQACKIGYYKALSTDATCAKCPPHSYSVWEGATSCTCDRGFFRADNDAASMPCTRPPSAPLNLISNVNETSVNLE WSSPQNTGRODISYNVVCKKCGAGDPSKCRPCGSGVHYTPQQNGLKTTKVSJTDLLAHTNYTFEIDAVNGVSKYNPNPDQSVSVTVTTNQAAPSSJALVQAKEVTRYSVALAW LEPDRPNGVILEYEVKYYEKDQNERSYRIVRTAARNTDIKGLNPLTSYVFHVRARTAAGYGDFSEPLEVCVAIKTLKAGYTDKQRRDFLSEASIMGQFDHPNIIHLEGVVTKCKPVMITEY ADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMITEY MENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVM WEVMSYGERPYWDMSNQDVIKAIEEGYRLPPPMDCPAIALHQLMLDCWQKERSDRPKFGQIVNMLDKLIRNPNSLKRTGTESSRPNTALLDPSSPEFSAVVSVGDWLQAIKMDR YKDNFTAAGYTTLEAVVHVNQEDLARIGITAITHQNKILSSVQAMRTQMCQOMHGRMVPV |
| EPHA5 | NP_004430 | P54756 | MRGSGPRGAGRRRPPSGGDTPITPASLAGCYSAPRRAPLWTCLLLCAALRTLLASPSNEVNLLDSRTVMGDLGWIAFPKNGWEEIGEVDENYAPIHTYQVCKVMEQNQNNW LLTSWISNEGASRIFIELKFTLRDCNSLPGGLGTCKETFNMYYFESDQNGRNIKENQYIKIDTIAADESFTELDLGDRVMKLNTEVRDVGPLSKKGFYLAFQDVGACIALVSVRVYYK KCPSVVRHLAVFPDTITGADSSQLLEVSGSCVNHSVTDEPPKMHCSAEGEWLVPIGKCMCKAGYEEKNGTCQVCRPGFFKASPHQSCGKCPPHSYTHEEASTSCVCEKDYFRES DPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVN VTTNQAAPSPVTNVKKGKIAKNSISLSWQEPDRPNGIILEYEKYFEKDQETSYTIKSKETTITAEGLKPGKPASVYFQIRARTAAGYGVFSRRFEFETTPVFAASSDQSQIPVIAVSVTVG VILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRE LPVAIKTLKVGYTEKQRRDFLEDDPEAAYTTRGGKIPIRWTAPEAIAFRKFTSASDVWSYGEWLEAIKMGRYTEIFMENGYSSMDAVAQVTLEDLRRLGVTLVGHQKKIMNSLQEMKVQLVNGMVPL MLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL |

FIG. 65 (CONT.)

| | | | |
|---|---|---|---|
| EPHA7 | NP_004431 | Q15375 | MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGV LGTCKETFNLYYETDYDTGRNIRENLVYKIDTIAADESFTQGDLGERKMKLNTEVREIGPLSKKGFYLAFQDVGACIALVSVKVYYKCWSIIENLAIFPDTVTGSEFSSLVEVRGTCV SSAEEEAENAPRMHCSAEGEMLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEW SPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSW OEPEHPNGVITEYEIKYYEKDQRERTYSTVKTKSTSASINNLKPGTVVFQIRAFTAAGYGNVSPRLDVATLEEATGKMFEATAVSSEQNPVIIIAVVAVAGTIILVFMVFGFHCGRRHC GYSKADQEGDEELYFHKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGV VTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTS ASDVWSYGIVMWEVMSYGERPYWDMSNQDVIKAEEGYRLPAPMDCPAGLHQLMLDCWQKERAERPKFEQIVGILDKMIRNPNSLKTPLGTCSRPISPLLDQNTPDFTTFCSV GEWLQAIKMERYKDNFTAAGYNSLESVARMTHEDVMSLGITLVGHOKKIMSSIQTMARAQMLHLHGTGIQV |
| EPHA8 | NP_065387 | P29322 | MAPARGRLRPALMVTVAAAAAATCVSAARGEVNLLDTSTIHGDWGWLTYPAHGWDSINEVDESFCQIHTYQVCNVMSPNQNNWLRTSWVPRDGARRVYAEIKFTLRDCNS MPGVLGTCKETFNLYYLESDRDLGASTQESQFLKIDTIAADESFTGADILGVRRLKLNTEVRSVGPLSKRGFYLAFQDIGACLAILSLRIYYKKCPAMVRRNLAAFSEAVTGADSSSLVEV RGQCVRHSEERDTPKMYCSAEGEMLVPIGKCVCSAGYEERRDACVACELGFYKSAPGDQLCARCPPHSHSAAPAAQACHCDLSYRAALDPPSSACTRPPSAPVNLISSVNGTSV TLEWAPPLDPGGRSDITYNAVCRRCPWALSRCEACGSGTRFVPQQTSLVQASLLVANLLAHMNYSFWIEAVNGVSDLSPERRAAVVNITTNQAAPSQVVIRQERAGQISVSL LWQEPEQPNGIILEYEIKYYEKDKEMQSYSTLKAVTTRATVSGLKPGTRYVFQVRARTSAGCGRFSQAMEVETGKPRPRYDTRTIVWICLTLTGLVVLLLICKKRHCGYSKAFQDS DEEKMHYQNGQAPPPVFLPLHHPGKLPEPQFYAEPHTYEEPGRAGRSFTREIEASRIHIEKIGSGDSGEVCVGRLRVPGQRDVPVAIKALKAGYTERQRRDFLSEASIMGQFDHP NIIRLEGVVTRGRLAMIVTEYMENGSLDTFLRTHDGQFTIMQLVGMLRGVGAGMRYLSDLGYVHRDLAARNILVDSNLVCKVSDFGLSRVLEDDPDAAYTTTGGKIPRWTAPE AIAFRTESASDVWSFGIVMWEVLAYGERPYWNMTNRDVISSVEEGYRLPAPMGCPHALHQLMLDCWHKDRAQRPRFSQIVSVLDALIRSPESLRATATVSRCPPPAFVRSCFD LRGGSGGGGGLTVGDWLDSIRMGRYRDHFAAGGYSSLGMVLRMNAQDVRALGITLMGHQKKILGSIQTMRAQLTSTOGPRRHL |
| EPHB1 | NP_004432 | P54762 | MALDYLLLLLASAVAAMEETLMDTRTATAELGWTANPASGWEEVSGYDENLNTIRTYQVCNVFEPNQNNWVLLTTFINRRGAHRIYTEMRFTVRDCSSLPNVPGSCKETFNLYY ETDSVIATKKSAFWSEAPYLKVDTIAADESFSQVDFGGRLMKVNTEVSFGPLTRNGFVLAFQDYGACMSLLSVRVFFKKCPSIVQNFAVFPETMTGAESTSLVIARGTCIPNAEEV DVPIKLYCNGDGEWMVPIGRCTCKPGYEPENSVACKACPAGTFKASQEAEGCSHCPSNSRPAEASPICTCRTGYYRADFDPPEVACTSVPSGPRNVISWNETSIILEWHPPRETG GRDDVTYNICKKCRADRRSCSRCDDNVEFVPRQLGLTECRVSISSLWAHTPYTFDIQAINGVSSAKSPFPPQHVSVNITTNQAAPSTVPIMHQVSATMRSITLSWPQEPQPNGILLD YEIRYYEKEHNEFNSSMARSQITNTARIDGLRPGMVYVVQVRARTVAGYGKFSGKMCFQITLTDDDYKSELREQLPLIAGSAAAGVFVVSLVAISIVCSRKRAYSKEAVYSDKLQHYS TGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENG ALDSFLRQNDGQFTVIQLVGMLRGIAAGMKYLSEMNYVHRDLAARNILVNSNLVCKVSDFGLSRYLQDDTSDPTYTSALGGKIPIRWTAPEAIAYRKFTSASDVWSYGIVMWEV MSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRD SFLTAGFTSLQLVTQMTSEDLLRIGITLAGHQKKILNSIHSMRVQISQSPTAMA |
| EPHB2 | NP_001296122 | P29323 | MALRRLGAALLLLPLLAAVEETLMDSTTATAELGWMAVHPPSGWEEVSGYDENMNTIRTYQVCNVFESSQNNWLRTKFIRRRGAHRIHVEMKFSVRDCSSIPSVPGSCKETFNLYY YEADFDSATKTFPNWMENPWVKVDTIAADESFSQVDLGGRVMKINTEVSFGPVSRSGFYLAFQDYGGCMSLAVRVFYRKCPRIIQNGAIFQETLSGAESTSLVAARGSCIANAE EVDVPIKLYCNGDGEWLVPIGRCMCKAGFEAVENGTVCRGCPSGTFKANOGDEACTHCPINSRTTSEGATNCVCRNGYYRADLPDLDMPCTTIPSAPQAVISSVNETSLMLEWT PPRDSGGGREDLVYNICKSCGSSRGACTRCGDNVQYAPRQLGLTEPRIYISDLLAHTQYTFEIQAVNGVTDQSPFSAVSMHQVSRTVDSITLSWSQPDQ PNGVILDYELQYYEKELSEYNATAIKSPTNTVTVQGLKAGAIYVFQVRARTVAGYGRYSGKMYFQTMTEAEYQTSIQEKLPLIGSSAAGLVFLIAVVVIAIVCNRRGFERADSEYTDK LQHYTSGHMTPGMKIYIDPFTYEDPNEAVREFAKEIDISCVKIEQVIGAGEFGEVCSGHLKPGKREIFVAIKTLKSGYTEKQRRDFLSEASIMGQFDHPNVIHLEGVVTKSTPVMHTE FMENGSLDSFLRQNDGQFTVIQLVGMLRGIAAGMKYLADMNYVHRDLAARNILVNSNLVCKVSDFGLSRYLQDDTSDPTYTSALGGKIPIRWTAPEAIQYRKFTSASDVWSYGI MWEVMSYGERPYWDMTNQDVINAIEQDYRLPPPMDCPSALHQLMLDCWQKDRNHRPKFGQIVNTLDKMIRRNPNSLKAMAPLSSGINLPLLDRTIPDYTSFNTVDEWLEAIK MGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQ GIFFKEDSHKESNDCSCGG |
| EPHB3 | NP_004434 | P54753 | MARARPPPPPSPPPGLLPLLPPLLPLLLLPAGGCRALEETLMDTKWVTSELAWTSHPESGWEEVSGYDEAMNPIRTYQVCNVRESSQNNWLRTGFIWRRDVQRVYVELKFTVRD CNSIPNIPGSCKETFNLFYYEADSDVASASSPFWMENPVVKVDTIAPDESFSRLDAGRVNTKVRSFGPLSKAGFYLAFQDQGACMSLISVRAFYKKCASTTAGFALFPETLTGAEPTS LVIAPGTCIPNAVEVSVPLKLYCNGDGEWMVPGVGACTCATGHEPAAKESQCRCPPGSYKAKQGEGPCLPCPPNSRTTSPAASICTCHNNFYRADSDSADSACTTVPSPPRGVIS NVNETSILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSS GSSLTLSWAPPERNPGVILDYEMKYFEKSEGIASTVLGIRPDRARYVVQGLRPDARYVVAGRYAGGYQSYRPAEEFETTSERGSGAQQLQEQLPIVGSATAGLVFVVAVVVIAIVC LRKQRHGSDSEYTEKLQQYIAPGMKYHDPFTYEDPNEAVREFAKEIDVSCVKIEEVIGAGEFGEVCRGRLKLKQYPGRREVFVAIKTLKVGYTERQRRDFLSEASIMGQFDHPNIIRLEG VVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRMWTAPEAIAYRKFT SASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFT TVGDWLDAIKMGRYKESFVSAGFASFDLVAQMTAEDLLRIGVTLAGHQKKILSSIQDMRLQMNCQTLPVQV |

FIG. 65 (CONT.)

| | | |
|---|---|---|
| EPHB4 | NP_004435 | P54760 | MELRVLLCWASLAAALEETTLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATATLPAWMENPYIKVDTVAAEHLTRKRPGAEATGKVNVKTLRGLPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQYRARSEAGYGPFGQEHHSQIQLDESEGWREQLALIAGTAVVGVVLVLVVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY |
| EPHB6 | NP_004436 | O15197 | MATEGAAQLGNRVAGMVCSLWVLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFLLYYRQAEEPDSPDSVSSWHLKRWTKVDTIAADESFPSSSSSSSSSAAWAVGPHGAGQRAGLQLNVKERSFGPLTORGFYVAFQDTGACLALVAVRLFSYTCPAVLRSFASFPETQASGAGGASLVAAVGTCVAHAEPEEDGVGGQAGGSPPRLHCNGEGKWMVAVGGCRCCOPGYQPARGDKACQACPRGLYKASAGNAPCSPCPARSHAPNPAAPVCPCLLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYIDPSTYEDPCQAIRELAREVDPAYIKIEEVIGTGSFGEVRQGRLQPGRREEQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV |
| ERBB2 | NP_004439 | P04626 | MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLREIQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLLEETIGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENGRIGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQHPPPAFSPAFDNLYYWDQDPPERGAPPSTFKGTPTAENPEYLGLDVPV |
| ERBB3 | NP_001973 | P21860 | MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLNRLRVVRGTQVYDGKFAIFVMLNYNTNSSHALRQLRLTQLTEILSGGVYIEKNDKLCHMDTIDWRDIVRDRDAEIVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNHTKYQYGGVCVASCPHNFVVDQTSCVRACPDKMEVDKNGLKMCEPCGGLCPKACEGTGSGSRFQTVDSSNIDGFVNCTKILGNLDFLTGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGROSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLEAEEDNLATTLGSALSLPVGTLNRPRGSQSLLSPSSGYMPMNQGNLGESCQESAVSGGSERCPRPVSLHPMPRGCLASESSEGHVTGSEAELQEKVSMCRSRSRSRSPRPRGDSAYHSQRHSLLTPVTFLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDEYEYMNRQRDGGGPGGDYAAMGACPASEQGYEEMRAFQGPGHQAPHVHYARLKTLRSLEATDSAFDNPDYWHSRLFPKANAQRT |

FIG. 65 (CONT.)

| | | |
|---|---|---|
| ERBB4 | NP_005226 | Q15303 | MKPATGLWVWVSLLVAAGTVQPSDSQSVCAGTENKLSLSSLDEQQYRALRKYYENCEVVMGNLEITSIEHNRDLSFLRSVREVTGYVLVALNQFRYLPLENLRIIRGTKLYEDRYAL AIFLNYRKDGNFGLQELGLKNLTEILNGGVYVDQNKFLCYADTIHWQDIVRNPWPSNLTLVSTNGSSGCGRCHKSCTGRCWGPTENHCQTLRTVCAEQCDGRCVGPYVSDCCH RECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACGIGTGSLMS AQTVDSSNIDKFINCTKINGNLIFLVTGIHGDPYNAIEAIDPEKLNVFRTVREITGFLNIQSWPPNMTDFSVFSNLVTIGGRVLYSGLSLLLKQQGITSLQFQSLKEISAGNIYITDNSNL CYYHTINWVITLFSTINQRIVJRDNRKAENCTAEGMVCNHLCSSDGCWGPGPDQCLSCRRFSRGICIESCNLYDGEFREFENGSICVECDPQCEKMEDGLLTCHGPGPDNCTKCS HFKDGPNCVEKCPDGLQGANSFIFKYADPDRECHPCHPNCTQGCNGPTSHDCIYYPWTGHSTLPQHARTPLIAAGVIGGLFLVIVGLTFAVVVRRKSIKKKRALRRFLETELVEPLT PSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKONIG SQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIP DLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNR SEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPK QEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRI RPIVAENPEYLSEFSLKPGTVLPPPPYRHRNTVV |
| FGFR1 | NP_075598 | P11362 | MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYF SVNVSDALPSSEDDDDDDDSSSEEKETONTKPNRMPVAPYWTSPEKMEKKLHAVPAAKTVKFKCPSSGTPNPTLRWLKNGKEFKPDHRIGGYKVRYATWSIIMDSVVPSDKGNY TCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAG NSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSE YELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARR PPGLEYCYNPSHNPEEQLSSKDLVSCAYCVARGMEYLASKKCIHRDLAARNVLVTEDNVMKIADFGLARDIHHIDYYKKTTNGRLPVKWMAPEALFDRIYTHQSDVWSFGVLLW EIFTLGGSPYPGVPVEELFKLLKEGHRMDKPSNCTNELYMMMRDCWHAVPSQRPTFKQLVEDLDRIVALTSNQEYLDLSMPLDQYSPSPDTRSSTCSSGEDSVFSHEPLPEEPCL PRHPAQLANGGLKRR |
| FGFR3 | NP_000133 | P22607 | MGAPACALALCVAVAIVAGASSESLGTEQRVVGRAAEVPGPEPGQQEQLVFGSGDAVELSCPPPGGQPMGPTVWVKDGTGLVPSERVLVGPQRLQVLNASHEDSGAYSCRQR LTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRG NYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCL AGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELP ADPKWELSRARLTLGKPLGEGCFGQVVMAEAIGIDKDRAAKPVTVAVKMLKDDATDKDLSDLVSEMEMMKMGIGKHKNIINLLGACTQGGPLYLVEYAAKGNLREFLRARRPP GLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWE IFTLGGSPYPGIPVEELFKLLKEGHRMDKPANCTHDLYMIKMRECWHAAPSQRPTFKQLVEDLDRVLTVTSTDEYLDLSAPFEQYSPGGQDTPSSSSGDDSVFAHDLLPAPPSSG GSRT |
| FGFR2 | NP_000132 | P21802 | MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSET WYFMVNVTDAISSGDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDK GNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTC LAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAG VSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYL RARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVTHQSDVWSF GVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMP YEPCLPQYPHINGSVKT |
| FGFR4 | NP_002002 | P22455 | MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLIT GDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENA VGSIRYNYLLDVLERSPHRPILQAGLPANTTAVVGGDVELLCKVYSDAQPHIQWLKHIVINGSSFGADGPYYQVLKTADINSSEVEVLYRNVSAEDAGEYTCLAGNSIGLSYQSAW LTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRL VLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPGPDLSPGPRSSE GPLSFPVLVSCAYQVARGMQYLESRKCIHRDLAARNVLVTEDNVMKIADFGLARGVHHIDYYKKTTSNGRLPVKWMAPEALFDRVYTHQSDVWSFGILLWEIFTLGGSPYGIPVE ELFSLLREGHRMDRPPHCPPELYGLMRECWHAAPSCRPTFKQLVEALDKVLLAVSEEYLDLRLTFGPYSPGSGDASSTCSSSDSVFSHDPLPLGSSSFPFGSGVQT |

FIG. 65 (CONT.)

| | | |
|---|---|---|
| LMTK2 | NP_055731 | MPGPGALRRRLLLLLVLLIAGSAGAAPLQTGAGEAPPAAEVSSFVILCVCSLHLIVLIANCVSCCKDPEIDFKEFEDNFDDEIDFTPPAEDTPSVQSPAEVFTLSVPNISLPAPSQFQ PSVEGLKSQVARHSLNYIQEIGNGWFGKVLLGEIYTGTSVARVIVKELKASANPKEQDTFLKNGEPYYLQHPNILQCVGQCVEAIPYLLVFEECDLGDLKAYLRSEQEHMRGDSQT MLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLS NLDVLNQVIRERDTKLPKPQLEQPYSDRWYEVLQFCWLSPEKRPAAEDVHRLLTYLRLQSORDSEVDFEQQWNALKPNTNSRDSSNNAAFPILDHFARDRLGREMEEVLTVTETS QGLSFEYVWEAAKHOHFDERSRGHLDEGLSYTSFYPVEVFESSLSDPGPGKQDDSGQDVPLRVPGVVPVFDAHNLSVGSDYYIQLEEKSGSMLELDYPPALLTTDMDNPERTGPE LSQLTALRSVELEESSTDEDFFQSSTDPKDSSLPGDLHVTSGPESPFNNIFNDVDKSEDLPSHQKIFDLMELNGVQADFKPATLSSLDNPKESVITGHFEKEKPRKIFDSEPLCLSDNL MHQDNFDPLNVQELSENFLFLQEKMLLKGSLSSKEHINDLQTELKNAGFTEAMLETSCRNSLDTELQFAENKPGLSLLQENVSTKGDDTDVMLTGDTLSTSLQSSPEVQVPPTSFET EETPRRVPPDSLPTQGETQPTCLDVDISPDAVTVPVEILSTDARTHSLDNRSQDSPGESEETLRLTESDSVLADDHLASRVSVGSSLPELGQELHNKPFSEDHHSHRRLE KNLEAVETLNQLNSKDAAKEAGVSALSSDSSTSQDSLLEDSLSAPFPASEPSLETPDSLESVDVHEALLDSLGSHTPQKLVPPDKPADSGYETENLESPEWTLHAPEGTADSEPATT GDGGHSGLPPNPVVISDAGDGHRGTEVTPETFLAGSQGSYRDSAYFSDNDSEPEKRSEEVPGTSPSALVLVQEQPLPEPVLPEQSPAAQDSCLEARKSQPDESCLSALHNSSDLEL RATPEPAQTGVPQQVHPTEDEASSPWSVLNAELSSGDFETQDDRPCTLASTGTNTNELLAYTNSALDKSLSSHSEGPKLKEPDIEGKYLGKLGVSGMILDSEDGMDADEEDENS DDSDEDLRAFNLHSLSSESEDETEHPVPHILSNEDGRHLRSLLKPTAANAPDPLPEDWKKEKKAVTFFDDVTVYLFDQETPTKELGPCGGEACGPDLSGPAPASGSPYLSRCINSESST DEEGGGFEWDDDFSPDPFMSKTTSNLLSSKPSLQTSKYFSPPPARSTEQSWPHSAPYSRFSISPANIASFSLTHLTDSDIEQGGSSEDGEKD |
| FLT1 | P17948 | MVSYWDTGVLLCALLSCLLLTGSSSGSKLKDPELSLKGTOHIMQAGQTLHLQCRGEAAHKWSLPEMVSKESERLSITKSACGRNGKQFCSTLTLNTAQANHTGFYSCKYLAVPTSK KKETESAIYIFISDTGRPFVEMYSEIPEIHMTEGRELVIPCRVTSPNITVTLKKFPLDTLIPPDGKRIIWDSRKGFIISNATYKEIGLLTCEATVNGHLYKTNYLTHRQTNTIDVQISTPRPVK LLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSM KVKAFPSPEVVWLKDGLPATEKSARYLTRGYSLIIKQVTEEDAGNYTILLSIKNGSNYFKNLTATLVVNKPQIYEKAVSSFPDPALYPLGSRQILTCTAYGIPQPTKWFWHPCNHNHSE ARCDFCSNNEESFILDADSNMGNRIESITQRMAIHEGKNKMASTLVVADSRISGIYICIASMNKVGTVGRNISFYLREATLVRRLLRNLSDHTVAISSSTTLDCHANGVPEPQITWFKNNHKIQQEPGIILGPGSST NRTMHYISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSST LFIERVTEEDEGGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKLGR GAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLE QGKKPRLDSVTSSEFSASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAP ESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTY STPAFSEDFFKESISAPKFNSGSSDDVRYVNAPKFMSLERIKTFEELLPNATSMFDDYQGDSTLLASPMLKRFTWTDSKPKASLKIDLRVTSKSKESGLSDVSRPSFCHSSCGHVSEG KRRFTYDHAELERKIACCSPPPDYNSVVLYSTPPI |
| FLT3 | NP_002010 | MPALARDGGQLPLLVVFSAMIFGTITNQDLPVIKCVLINHKNNDSSVGKSSYPMVSESPEDLGCALRPQSSGTVYEAAAVEVDVSASITLQVLVDAPGNISCLWVFKHSSLNCQP HFDLQNRGVVSMVILKMETQAGEYLLFIQSEATNYTILFTVSIRNTLLYTLRRPYFRKMENQDALVCISESVPEPIVEWVLCDSQGESCKEESPAVVKKEEKVHLELFGTDIRCCARN ELGRECTRLFTIDLNQTPQTTLPQLFLKVGEPLWIRCKAVHVNHGFGLTWELENKALEEGNYFEMSTYSTNRTMIRILFAFVSSVARNDTGYTCSSSKHPSQSALVTIVEKGFINAT NSSEDYEIDQYEEFCFSVRFKAYPQIRCTWTFSRKSPFCEQKGLDNGYSISKFCNHKHQPGEYIFHAENDAQFTKMFTLNIRRPVQVLAEASASQASCFSDGYPLPSWTWKKCSD KSPNCTEEITEGVWNRKANRKVFGQWVSSSTLNMSEAIKGFLVKCCAYNSLGTSCETLLNSPGPFPFIQDNISFYATIGVCLLFVVLTLLICHKYKKQFRYESQLQMVQVTGSSDNE YFVDFREYEYDLKWEFPRENLEFGKVLGSSGAFGKVMNATAVGISKTGVSIQVAVKMLKEKADSSEREALMSELKMMTQLGSHENIVNLLGACTLSGPYYLIFEYCCYGDLLNYLRS KREKFHRTWTEIFKEHNFSFYPTFQSHPNSSMPGSREVQIHPDSDQISGLHGNSFHSEDEIEYENQKRLEEEDLNVLTFEDLLCFAYQVAKGMEFLEFKSCVHRDLAARNVLVTHG KVVKICDFGLARDIMSDSNYVVRGNARLPVKWMAPESLFEGIYTIKSDVWSYGILLWEIFSLGVNPYPGIPVDANFYKLIQNGFRKMDQPFYATEEIYIIMQSCWAFDSRKRPSFPNL TSFLGCQLADAEEAMYQNVDGRVSECPHTYQNRRPFSREMDLGLLSPQAQVEDS |
| FLT4 | P35916 | MCRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYK YIKARIEGTTAASSVYVFVRDFEQPFINKPDTLLVNRKDAMMVPCLVSIPGLNVTLRSQSSVLWPDGQEVVWDDRRGMLVSTPLLHDALYLQCETTWGDQDFLSNPFLVHTGNEL YDIQLLPRKSLELLVGEKLVLNCTVWAEFNSGVTFDWDYPGKQAERGKWVPERRSQQITHTELSSILTIHNVSQHDLGSYVCKANNGIQRFRESTEVIVHENPFISVEWLKGPILEAT AGDELVKLPVKLAAYPPPEFQWYKDGKALSGRHSPHALVLKEVTEASTGTYTLALWNSAAGLRRNISLELVVNVPPQIHEKEASSPSYSRHSRQALTCTAYGVPLPLSIQWHWRP WTPCKMFAQRSLRRRQQQDLMPQCRDWRAVTTQDAVNPIESLDTWTEFVEGKNKTVSKLVIQMANVSAMYKCVVSNKVGQDERLIYFVVTTIPDGFTIESKPSEELLEGQPVLL SCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVS DSLEMQCLVAGAHAPSIVMVWKDERLLEEKSGVDLADSNQKLSIQRVREEDAGRYLCSVCNAKGCVNSSASVAVEGSEDKGSMEIVILVGTGVIAVFFWVLLLLIFCNMRRPAHADI KTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLM VIVEFCKYGNLSNFLRAKRDAFSPCAEKSPEQRGRFRRAMVELARLLDRRPGSSDRVLFARFSKTEGGARRASPDQEAEDLWLSPLTMEDLLCYSFQVARGMEFLASRKCIHRDLAA RNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDP KARPAFSELVEILGDLLQGRGLQEEEVCMAPRSSQSSEEGSFSQVSTMALHIAQADAEDSPPSLQRHSLAARYYNWVSFPGCLARGAETRGSSRMKTFEEFPMTPTTYKGSVDN QITDSGMVLASEEFEQESRHRQESGFSCSCKGPGQNVAVTRAHPDSQGRRRPERGARGGQVFYNSEYGLSEPSEEDHCSPSARVTFFTDNSY |

FIG. 65 (CONT.)

| | | |
|---|---|---|
| ALK | NP_004295 | Q9UM73 | MGAIGLLWLLPLLLSTAAVGSGMGTGQRAGSPAAGPPLQPREPLSYSRLQRKSLAVDFVVPSLFRVYARDLLPPSSEELKAGRPEARGSLALDCAPLLRLLRLLGPAPGVSWTAGSPAP AEEARTLSRVLKGGSVRKLRRAKQLVLELGEEAHLEGCVGPPGEAAVGLLQFNLSELFSWWIRQGEGRLRIRLMPEKKASEVGREGRLSAAIRASQPRLLFQIFGTGHSSLESPTNMPS PSPDYFTWNLTWIMKDSFPPLSHRSRYGLECSFDFPCELEYSPPLHDLRNQSWSWRRIPSEEASQMDLLDGPGAERSKEMPRGSFLLLNTSADSKHTILSPWMRSSSEHCTLAVSV HRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGE DESQMCRKLPVGFYCNFEDGFCGWTQGTLSPHTPQWQVRTLKDARFQDHQDHALLSTTDVPASEASATVTSATFPAPIKSSPCELRMSWLIRGVNSLVLVENKTGKEQGR MVWHVAAYEGLSLWQWMVLPLLDVSDRFWLQMVAWWGQGSRAIVAFDNISILDCYLTISGEDKILQNTAPKSRNLFERNPNKELKPGENSPRQTPIFDPTVHWLFTCGAS GPHGPTQAQCNNAYQNSNLSVEVGSEGPLKGIQWKVPATDTYSISGYGAAGGKGKNTMMRSHGVSVLGIFNLEKDDMLYILVGQQGEDACPSTNQLIQKVCIGENNVIEEEI RVNRSVHEWAGGGGGGGGGATVVFKMKDGVPVPLIIAAGGGRAYGAKTDTFHPERLENNSSVLGLNGNSGAAGGGGWNDNTSLLWAGKSLQEGATGGHSCPQAMKKW GWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPT PEPHLPLSLILSVVTSALVAALVLAFSGIMIVYRRKHQELQAMQMELQSPEYKLSKLRTSTIMTDYNPNYCFAGKTSSISDLKEVPRKNITLRGLGHGAFGEVVEGQVSGMPNDPSP LQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPG RVAKIGDFGMARDIYRASYYRKKGCAMLPVKWMPPEAFMEGIFTSKTDTWSFGVLLWEIFSLGYMPYPSKSNQEVLEFVTSGGRMDPPKNCPGPVYRIMTQCWQHQPEDRP NFAIHLERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKV HGSRNKPTSLWNPTYGSWFTEKPTKKNNPIAKKEPHDRGNLGLEGSCTVPPNVATGRLPGASLLLEPSSLTANMKEVPLFRLRHFPCGNVNVGYQQQGLPLEAATAPGAGHYED TILKSKNSMNQPGP |
| EPHA10 | NP_001092909 | Q5JZY3 | METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSI PGAAGTCKETFNVYYLETEADLGRGRPRLGGSRPRKIDTIAADESFTQGDLGERKMKLNTEVREIGPLSRRGFHLAFQDVGACVALVSVRVYKQCRATVRGLATFPATAAESAFST LVEVAGTCVAHSEGEPGSPPPRMHCGADGEWLVPVGRCSCSAGFQERGDFCEACPPGFYKVSPRRPLCSPCPEHSRALENASTFCVCQDSVARSPTDPPSASCTRPPSAPRDLQYS LSRSPLVLRLRWLPPADSGGRSDVTYSLLCLRCGREGPAGACEPGCPRVAFLPRQAGLRERAATLLHRPGARYTVRVAALNGVSGPAAAAGTTYAQVTVSTGPGAPWEEDEIRR DRVEPQSVSLSWREPIPAGAPGANDTEYERRYYEKGQSEQTYSMVKTGAPTVTVTNLKPATRYVFQIRAASPGPSWEAQSFNPSIEVQTLGEAASGSRDQSPAIVVTVVTISALLVL GSVMSVLAIWRRPCSYGKGGDGDAHDEEELYFHFKVPTRRTFLDPQSCGDLLQAVHLFAKELDAKSVTLERSLGGGRFGELCCGCLQLPGRQELLVAVHMLRDSASDSQRLGFLAE ALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTMSGRS PALWWAAPETLQFGHFSSASDVWSFGIMMWEVMAFGERPYWDMSGQDVIKAVEDGFRLPPPRNCPNLLHRLMLDCWQKDPPGERPRFSQIHSILSKMVQDPEPPKCALTTCPRP PTPLADRAFSTFPSFGSVGAWLEALDLCRYKDSFAAAGYGSLEAVAEMTAQDILVSLGISLAEHREALLSGISALQARVLQLQGQGVQV |
| EPHA6 | NP_001265229 | Q9UF33 | MKDSPFCQVTKLYWLNEKWDFIASASDMAAAEQGQLVIATAAVGGFTLLVLTLFFLITGRCQWYIKAKMKSEEKRRNHLQNGHLRFPGIKTYIDPDTYEDPSLAVHEFAKEIDPSRIR IERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGSLPPRIPAGRPVMIV VEYMENGSLDSFLRKHDGHFTVIQLVGMLRGIASGMKYLSDMGYVHRDLAARNILVNSNLVCKVSDFGLSRVLEDDPEAAYTTRPTNHNKEQSELVKEDGLESLCEQCESSSGY GTGLVLMWKKRNRAMGASGQTRKQCDKRDNPPTDLFQTLTLNLCYSA |
| IGF1R | NP_000866 | P08069 | MKSGSGGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVFE MTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECL GSCSAPDNDTACVACRHYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQ GCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTK GRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAV TLTMVENDHIRGAKSEILVIRTNASVPSIPLDVLSASNSSSQLIVKWNPPSLPNGNLSYYIVRWQRQPQDGYLRHNYCSKDKIPIRKYADGTIDIEEVTENPKTEVCGGEKGPCCACP KTEAEKQAEKEEAEYRKVFENFLHNSIFVPRPERKRRDVMQVANTTMSSRSRNTTAADTYNITDPEELETEYPFFESRVDNKERTVISNLRFFTLYRIDIHSCNHEAEKLGCSASNFVF ARTMPAEGADDIPGPVTWEPRPENSIFLKWPEPENPNGLILMYEIKYGSGVEDQRECVSRQEYRKYGGAKLNRLNPGNYTARIQATSLSGNGSWTDPVFFYVQAKTGYENFIHLII ALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASV MKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDY YRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVS FYYSEENKLPEPEELDLEPENMESVPLDPSASSSSLPLPDRHSGHKAENGPGPGVVLVRASFDERQPYAHMNGGRKNERALPLPQSSTC |

FIG. 65 (CONT.)

| | | |
|---|---|---|
| INSR | NP_000199 | MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYA LVIFEMVHLKELGLYNLMNITRGSVRIEKNNELCYLATIQWSRILDSVEDNYIVLNKDDNEECGDICPGTAKGKTNCPATVINGQFVERCWTHSHCQKVCPTICKSHGCTAEGLCCH SECLGNCSQPDDPTKCVACRNFYLDGRCVETCPPPYHFQDWRCVNFSFCCQDLHHKCKNSRRQGCHQYVIHNNKCIPECPSGYTMNSSNLLCTPCLGPCPKVCHLLEGEKTIDSV TSAQELRGCTVINGSLIINRGGNNLAAELEANLGLIEEISGYLKIRRSYALVSLSFFRKLRLRGETLEIGNYSFYALDNQNLRQLWDWSKHNLTITQGKLFFHYNPKLCLCSEIHKMEEVS GTKGRQERNDIALKTNGDQASCENELLKFSYIRTSFDKILLRWEPYVWPPDFRDLLGFMLFYKEAPYQNVTEFDGQDACGSNSWTVVDIDPPLRSNDPKSQNHPGWLMRGLKPW TQYAIFVKTLVTFSDERRTYGAKSDIIVQTDATNPSVPLDPISVSNSSSQJILKWKPPSDPNGNITHYLVFWERQAEDSELFELDYCLKGLKLPSRTWSPPFESEDSQKHNQSEYDS AGECCSCPKTDSQLLKELEESSFRKTFEDYLHNVVFVPRKTSSGTGAEDPRPSRKRRSLGDVGNVTVAYPTVAAFPNTSSTSVPTSPEEHRPFEKVVNKESLVISGLRHFTGYRIELQA CNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEP TYFVTDYLDVPSNIAKIIIGPLIPVEFLSVVIGSIYLFLRKRQPDGPLGPLYASSNPEYLSADVFPCSVVPDEWEVSREKITLLRELGQGSFGMVVEGNARDIIKGEAETRVAVKTVNE SASLREIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVK IGDFPMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLE IVNLLKDDLHPSFPEVSFFHSEENKAPESEELEMEFEDMENVPLDRSSHCQREEAGSGRDGGSSLGFKRSYEEHIPYTHMNGGKKNGRILTLPRSNPS |
| INSRR | NP_055030 | MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFGYALVIFE MPHLRDVALPALGAVERGAVRVEKNQELCHLSTIDWGLLQPAPGANHIVGNKLGEECADVCPGVLGAAGEPCAKTTFSGHTDYRCWTSSHCQRVCPHGMACTARGECCHT ECLGCSCQPEDPRACVACRHLYFQGACLWACPPGTYQYESWRCVTAERCASLHSVPGRASTFGIHOGSCLAQCPSGFTRNSSIFCHKCEGLCPKECKVGTKTIDSIQAAQDLVGC THVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHYRLEEVTGTRGR QNKAEINPRTNGDRAACCQTRTLRFVSNVTEADRILLRWERYEPLEARDLLSFIVYYKESPFQNATEHVGPDACGTQSWNLLDVELPLSRTQEPGVTLASLKPWTQYAVFVRAITLT EEDSPHQGAGQSPIVYLRTLPAAPTVPQDVISTSNSSSHLLVRWKPPTQRMGNLTYYLVLWQRLAEDGDLYLNDYCHRGLRLPTSNNDPRFDGEDGDPEAEMESDCCPCQHPPPG QVLPLEAQEASFQKKFENFLHNAITPISPWKVTSINKSPQRDSGRHRRAAGPRLGGNSSDFEIQEDKVPRERAVLSGLRHFTEYRIDIHACNHAAHTVGCSAATFVFARTMPHR EADGIPGKVAWEASSKNSVLRWLEPPDPNGLIUKYEIKYRRLGEEATVLCVSRLRYAKFGGVHLALLPPGNYSARVRATSLAGNGSWTDSVAFYILGPEEEDAGGLHVLLTATPVG LTLIVLAALGFFYGKKRNRTLYASVMPEYFSASDMYVPDEWEVPREQISHIRELGQGSFGMVYEGLARGLEAGEESTPVALKTVNELASPRECIEFLKEASVMKAFKCHHVVRLGV VSQGQPTLVIMELMTRGDLKSHLRSLRPEAENNPGLPQPAGLEMIQMAGEIADGMAYLAANKFVHRDLAARNCMVSQDFTVKIGDFGMTRDYETDYYRKGGKGLLPVRWM APESLKDGIFTTHSDVWSFGVVLWEIVTLAEQPYQGLSNEQVLKFVMDGGYLEELEGCPLQLQELMSRCWQPNPRLRPSFTHILDSIQEELRPSFRLLSFYYSPECRGARGSLPTTD APEDSSPTPRDCSPQNGGPGH |
| KDR | NP_002244 | MQSKVLLAVALWLCVETRAASVGLPSVSLDLPRLSIQKDILTIKANTTLQITCRGQRDLDWLWPNNQSSSEQRVEVTECSDGLFCKTLTIPKVIGNDTGAYKCFYRETDLASVIYVYV QDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVGYRIYDVVLSPSHGIELSV GEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKY LGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQA VSVTNPYPCEEWRSVEDFQGGNNIEVNKNQFALIEGKNKTVSTLVIQAANVSALYKCEAVNKVGRGERVISFHVTRGPEITLQPDMQPTEQESVSLWCTADRSTFENLTWYKLGP QPLPIHVGELPTPVCKNLDTLWLNATNFSNSTNDLIMELKNASLQDQGDYVCLAQDRRTKKRHCVVRQLTVLERVAPTITGNLENQTGSIEVSCSTASGNPPQIMWFKDN ETLVEDSGIVLKDGNRNLTIRRVRKEDEGLYTCQACSVLGCAVEAFFIEGAQEKTNLEIIIILVGTAVIAMFFWLLLVIILRTYKRANGGELKTGYLSIVMDPDELPLDEHCERLPYDAS KWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKG ARFRQGKDYVGAIPVDLKRRLDSITSSQSAAASGPVEEKSLSDVEEEAPEDLYKDFLTLEHLICYSFQVAKGMEFLASRKCIHRDLAARNILSEKNVVKICDFGLARDIYKDPDYVRK GDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYI VLPISETLSMEEDSGLSPTSPVSCMEEEEVCDPKFHYDNTAGISCQYLQNSKRKSRPVSVKTFEDIPLEEPEVKVIPDDNQTDSGMVLASEELKTLEDRTKLSPSFGGMVPSKSRESVA SEGSNQTSGYQSGYHSDDTDTTVYSSEEAELLKLIEIGVQTGSTAQHLQPDSGTTLSSPPV |
| KIT | NP_000213 | MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKL FLVDRSLYGKEDNDTLVRCPLTDPEVTNYSLKGCQGKPLFIPDPKAGIMIKSVKRAYHRLCLHCSVDQEGKSVLSEKFILKVRPAFKAVPVVSVSKASYLLREGEEFTVTCTIKD VSSSVYSTWKRENSQTKLQEKYNSWHHGDFNVERQATLTISSARVNDSGVFMCYANNTFGSANVTTLEVVDKGFINIFPMINTTVFVNDGENVDLIVEYEAFPKPEHQQWIYM NRTFTDKWEDYPKSENESMRYVSELHLTRLKGTEGGTYTFLVSNSDVNAAIAFNVYVNTKPEILTYDRLVNGMLQCVAAGFPEPTIDWMFVFCPGTEQRCSASVLPVDVQTLNSSGP PFGKLVVQSSIDSSAFKHNGTVECKAYNDVGKTSAYFNFAFKGNNKEQIHPHTLFTPLLIGFVIVAGMMCIIVMILTYKYLQKPMYEVQWKVVEEINGNNYYVIDPTQLPYDHKWE FPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEA ALYKNLLHSKESSCSDSTNEYMDMKRPGVSYVPTKADKRRSVRIGSYIERDVTPAIMEDDELALDLEDLLSFSYQVAKGMAFLASKNCIHRDLAARNILLTHGRITKICDFGLARDIK NDSNYVKANCSPNRQKPVVDHSVRINSVGSTASSSQPLLVHDDV |

FIG. 65 (CONT.)

| | | | |
|---|---|---|---|
| LTK | NP_002335 | P29376 | MGCWGQLLVWFGAAGAILCSSPGSQETFLRSSPLPLASPSRDPKVSAPPSILEPASPLNSPGTEGSWLFSTCGASGRHGPTQTQCDGAVAGTSVVTVGAAGQLRGVQLWRYP GPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGATYVFRVRAGELEP LLVAAGGGGRAYLRPRDRGRTQASPEKLENRSEAPGSGGRGAAGGGGWTSRAPSPQAGRSLQEGAEGGQGCSEAWATLGWAAAGGFGGGGACTAGGGGGGYRGGD ASETDNLWADGEDGVSFHPSSELFLQPLAVTENHGEVEIRRHLNCSHCPLRDCQWQAELQLAECLCPEGMELAVDNVTCMDLHKPPGPLVLMVAVVATSTLSLLMVCGVLILV KQKKWQGLQEMRLPSPELELSKLRTSAIRTAPNPYYCCQVGLGPAQSWPLPPGVTEVSPANVTLLRALGHGAFGEVYEGLVIGLPGDSSPLQVAIKTLPELCSPQDELDFLMEALIISK FRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRA LLPVKWMPPEAFLEGIFTSKTDSWSFGVLLWEIFSLGYMPYPGRTNQEVLDFVVGGGRMDPPRGCPGPVVRIMTQCWQHEPELRPSFASILERLQYCTQDPDVLNSLLPMELGP TPEEEGTSGLGNRSLECLRPPQPQELSPEKLKSWGGSPLGPWLSSGLKPLKSRGLQPQNLWNPTYRS |
| MET | NP_000236 | P08581 | MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNI NMALVVDTYDDQLISCGSVNRGTCQRHVFPHNHTADIQSEVHCIFSPQEEPSQCPDCVVSALGAKVLSSVKDRFINFFVGNTINSSYFPDHPLHSISVRRLKETKDGFMFLTDQS YIDVLPEFRDSYPIKYVHAFESNNFIYFLTVQRETLDAQTFHTRIIRFCSINSGLHSYMEMPLECILTEKRKKRSTKKEVFNILQAAVVSKPGAQLARQIGASLNDDILFGVFAQSKPDSA EPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRS GPSTPHVNFLLDSHPVSPEVIVEHTLNQNGYTLVITGKITPLNGLGCRHFQSCSQCLSAPPFVCQCWHDKCVRSEECLSGTWTQQJCLPAIYKVFPNSAPLEGGTRLTICGWD FGFRRNNMKFDLKKTRVLLGNESCTLTLSESTMNTLKCTYGPAMNKHFNMSIISNGHPYLTPTKSFISGGSTITVCSSGKNLNSVSVPRMVINVHEAGRNFTVACQHRSNSEIICCTTPSLQQLNLQLPLKTKAFFMLDGILS LECYTPAQTISTEFAVKLKIDLANRETSIFSYREDPVYEHPTKSFISGGSTITVCSKFISGGSTITVGTYLGNFTGLJAGVVSISTALLL KYFDLIYVHNPVFKPFEKPVMJSMGNENVLEKGNDIDPEAVKGEVLKVGNKSCENIHLHSEAVLCTVPNDLLKLNSELNIEWKQAISSTVLGKVIVQPDQNFTGLJAGVVSISTALLL LLGFFLWLKKRKQJKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQ AVQHYVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIG FGLQVAKGMKYLASKKFVHRDLAARNCMLDEKFTVKVADFGLARDMYDKEYYSVHNKTGAKLPVKWMALESLQTQKFTTKSDVVSFGVLLWELMTRGAPPYPDVNTFDITVY LLQGRRLLQPEYCPDPLYEVMLKCWHPKAEMRPSFSELVSRISAJFSTFHGEHYVHVNATYVNVKCVAPYPSLLSSEDNADDEVDTRPASFWETS |
| MST1R | NP_002438 | Q4912 | MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQGPGHGP PGDTDKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAP GFVALSVLPKHLVSYSIEYHSFHTGAFVYFLTVQPASVTDDPSALHTRLARLSATEPELGDYRELVLDCRFAPKRRRGAPEGGQPYPVLRVAHSAPVGAQLATELSIAEGQEVLFG VFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMG TMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFH PHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPL FGPRAGGTCLTLEGQSLSVGTSRAVLVNGTECLLARVSEGQLLCATPPGATVASVPLSLQVGGAQVPGSWTFQYREDPVVLSISPNCGYINSHTICGQHLTSAWHLVLSFHDGLR AVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMNVVCPLPPSLQ LGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASF SDSEDESCVPLLRKESIQLRDLDSALLAEVKDVLPHERVVTHSDRVIGKGHFGVVYHGEYIDQAQNRIQCAIKSLSRITEMQQVEAFLREGLLMRGLNHPNVLALIGIMLPPEGLPH VLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVVS FGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPG NVRRPRPLSEPPRPT |
| MUSK | NP_005583 | O15146 | MRELVNIPLVHRLTVAFSGTEKLPKAPVITTPLETVDALVEEVATFMCAVESYPQPEISWTRNKILIKLFDTRYSIRENGQLLTILSVEDSDDGIVCCTANNGVGGAVESCGALQVKM KPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIP VPTITWIENGNAVSSGISGIQESVKDRVIDSRLQLFTKPGLYTCIATNKHGEKFSTAKAAATISIAEWSKPQKDNKGYCAQYRGEVCNAVLAKDALVFLNTSYADPEEAQELLVHTAW NELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSV DIPNLPSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEAGFRVFQARA PGLLPYEPFTMVAVKMLKEEASADMQADFQREAAALMAEFDNPNIVKLLGVCAVGKPMCLLFEYMAYGDLNEFLRSMSPHTVCSLSHSDLSMRAQVSSPGPPPLSCAEQLCIAR QVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILS CPENCPVELYNLMRLCWSKLPADRPSFTSIHRILERIMCERAEGTVSV |

FIG. 65 (CONT.)

| | | |
|---|---|---|
| NTRK1 | NP_002520 P04629 | MLRGGRRGQLGWHSWAAGPGSLLAWLILASAGAAPCPDACCPHGSSGLRCTRGGALDSLHHLPGAENLTELYEIVIENQQHLQHELRDLIRGLGELRNLTIVKSGLRFVAPDAFHFT PRLSRLNLSFNALESLSWKTVQGLSLQELVLSGNPLHCSSCALRWLQRWEEGLGGVPEQKLQCHGQGPLAHMPNASCGVPTLKVQVPNASVDVGDDVLRCQVEGRGLEQAG WILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANET VRHGCLRLNQPTHVNNGNYTLAANPFGQASASIMAAFMDNPFEFNPEDPIPVSFSPVDTNSTGGPVEKKDETPFGVSVAVGLAVFACLFLSTLLLVLNKCGRRNKFGINRPAVL APEDGLAMSLHFMTLGGSSLSPTEGKGSSGLQGHIIENPGYFSDACVHHIKRRDIVLKWELGEGAFGKVFLAECHNLLPEQDKMLVAVKALKEASESARQDFQREAELLTMLQHQ HIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVKIGDFGMSRDIYSTDYYRV GGRTMLPIRWMPPESILYRKFTTESDVWSFGVVLWEIFTYGKQPWYQLSNTEAIDCITQGRELERPRACCPPEVYAIMRGCWQREPQQRHSIKDVHARLQALAQAPPVYLDVLG |
| NTRK2 | NP_001018074 Q16620 | MSSWIRWHGPAMARLWGFCWLVVGFWRAAFACPTSCKCSASRIWCSDPSPGIVAFPRLEPNSVDPENTEFIANQKRLEINEDDVEAYVGLRNLTIVDSGLKFVAHKAFLKNS NLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVG NLVSKHMNETSHTQGSLRITNISSDDSGKQJSCVAENLVGEDQDSVNLTVHFAPTITFLESPTSDHHWCIPFTVKGNPKPALQWFYNGAILNESKYICTKIHVTNHTEYHGCLQLDN PTHMNNGDYTLIAKNEYGKDEKQISAHFMGWPGIDDGANPNYPDVIYEDYGTAANDIGDTTNRSNEIPSTDVTDKTGREHLSVYAVVVIASVGFCLLVMLFLLKLARHSKFGM KGPASVISNDDDSASPLHHISNGSNTPSSSEGGPDAVIIGMTKIPVIENPQYFGITNSQLKPDTFVQHKRHNIVLKRELGEGAFGKVFLAECYNLCPEQDKILVAVKTLKDASDNARK DFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFG MSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQN LAKASPVYLDILG |
| NTRK3 | NP_001012338 | MDVSLCPAKCSFWRIFLLGSVMLDYVGSVLACPANCVCSKTEINCRRPDDGNLFPLLEGODSGNSNGNASINITDISRNITSIHIENWRSLHTLNAVDMELYTGLQKLTIKNSGLRSI QPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNG SGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIH VEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVLVFVMINKYGRRSKFGMKGPV AVISGEEDSASPLHHINHGITTPSSLDAGPDTVVGMTRIPVIENPQYFRCGHNCHKPDTYVQHIKRRDIVLKRELGEGAFGKVFLAECYNLSPTKDKMLVAVKALKDPTLAARKDF QREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDF GMSRDVYSTDYYRVRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREP QQRLNIKEIYKILHALGKATPIYLDILG |
| ROR1 | NP_005003 Q01973 | MHRPRRRGTRPPLLALLAALLLAARGAAAQETELSVSAELVPTSSWNISSELNKDSYLTLDEPMNNTTTSLGQTAELHCKVSGNPPPTIRWFKNDAPVVQEPRRLSFRSTIYGSRLRI RNLDTTDTGYFQCVATNGKEVSSTGVLFVKFGPPPTASPGYSDEYEEDGFCQPYRGIACARFIGNRTYVMESLHMQGEIENQIITAAFTMIGTSSHLSDKCSQFAIPSLCHYAFPYC DETSSVPKPRDLCRDECEILENVLCQTEYFARSNPMILMRLKLPNCEDLPQPESPEAANCIRIGIPMADPINKNHCYNSTGVDYRGTVSTVSTKSGRQCQPWNSQYPHTHTFTALRF PELNGGHSYCRNPGMQKEAPWCFTLDENFKSDLCDIPACDSDKEKNKMEILYILVPSVAIPLAIALLFFICVCRNNQKSSSAPVQRQPKHVRGQNVEMSMLNAYKPSKAKEL PLSAVRFMEELGECAFGKIYKGHLYLPDMDHAQLVAIKTLKDYNNPQQWTEFQQEASLMAELHHPNIVCLLGAVTQEQPVCMLFEYINQGDLHEFLIMRSPHSDVGCSSDEDGT VKSSLDHGDFLHIAIQIAAGMEYLSSHFFVHKDLAARNILIGEQLHVKISDLGLSREIYSADYYRVQSKSLLPIRWMAPPEAIMYGKFSSDSDIWSFGVVLWEIFSGLQPYYGFSNQEVI EMVRKRQLLPCSEDCPPRMYSLMTECWNEIPSRRPRFKDIHVRLRSWEGLSHTSSTTPSGGNATTQTTSLSASPVSNLSNPRYPNYMFPSQGITPQGQIAGFIGPPPQNQRFIPI NGYPIPPGYAAFPAAHYQPTGPPRVIQHCPPPKSRSPSSASGSTSTGHVTSLPSSGSNQEANIPLLPHMSIPNHPGGMGITVGFNKSQKPYKIDSKQASLLGDANIHGHTESMISAE L |
| ROR2 | NP_004551 Q01974 | MARGSALPRRPLLCIPAVWAAAALLLSVSRTSGFVELVDPNDPLGPLDGQDGPIPTLKGYFLNFLEPVNNITIVQGQTAILHCKVAGNPPPNVRWLKNDAPVVQEPRRIIRKTEYG SRLRIQDLDTTDTGYYQCVATNGMKTITATGVLFVRLGPTHSPNHNFQDDYHEDGFCQPYRGIACARFIGNRTIYVDSLOMQGEIENRITAAFTMIGTSTHLSDQCSQFAIPSFCHF VFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSH HLSSTDFPELGGGHAYCRNPGGQMEGGPWCFTQNKNVRMELCDVPSCSPRDSSKMGILYILVPSIAIPLVIACLFFLVCMCRNKQKASASTPQRRQLMASPSQDMEMPLINQHK QAKLKEILSSAVRFMEELGEDRFGKVYKGHLFGPAPGEQTQAVAIKTLKDKAEGPLREEFRHEAMLRARLQHPNVVCLLGVTKDQPLSMIFSYCSHGDLHEFLVMRSPHSDVGS TDDDRTVKSALEPPDFVHLVAQIAAGMEYLSSHHVVHKDLATRNVLVYDKLNVKISDLGLFREVVAADYYKLLGNSLLPIRWMAPEAIMYGKFSIDSDIWSYGVVLWEVFSYGLQP YCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMK GQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAFEEE EGSVPETELLGDCDTLQVDEAQVQLEA |

FIG. 65 (CONT.)

| | | | |
|---|---|---|---|
| DDR2 | NP_001014796 | Q16832 | MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFTTLVGTQGRHAGGHGIEFAPMY KINYSRDGTRWISWRNRHGKQVLDGNSNPYDIFLKDLEPPIVARFVRFIPVTDHSMNVCMRVELYGCVWLDGLVSYNAPAGGQFVLPGGSIHYLNDSVYDGAVGYSMTEGLGQL TDGVSGLDDFTQTHEYHVWPGYDYVGWRNESATNGYIEIMFEFDRIRNFTTMKVHCNNIMFAKGVKIFKEVQCYFRSEASEWEPNAISFPLVLDDVNPSARFVTVPLHHRMASAI KCQYHFADTWMMFSEITTFQSDDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSP SEQGSNSTYDRIFPLRPQYCQEPSRLIRKLPEFAPGEEESGCSGVVKPVQPSGPEGVPHYAEADIVNLQGVTGGNTYSVPAVTMDLLSGKDVAVEEFPRRKLLTFKEKLGEGCFGEVHL CEVEGMEKFKDKDFALDVSANQQPVLVAVKMLRADANKNARNDFLKEIKIMSRLKDPNIIHLLAVCITDDPLCMITEYMENGDLNQFLSRHEPPNSSSSDVRTVSYTNLKFMATQIA SGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGR QTYLPQPAICPDSVYKLMLSCWRRDTKNRPSFQEIHLLLLQQGDE |
| PDGFRA | NP_006197 | P16234 | MGTSHPAFLVLGCLLTGLSILILCQLSLPSIPNENEKVVQLNSSFSLRCFGESEVSWQYPMSEEESSDVEIRNEENNSGLFVTVLEVSSASAAHTGLYTCYYNHTQTEENELEGRHIYIY VPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVF NNEVVDLQWTYPGEVKGKGITMLEEIKVPSIKLVPTLTVPEATVKDSGDYECAARQATREVKEMKKVTISVHEKGFIEIKPTFSQLEAVNLHEVKHFVVEVRAYPPPRISWLKNNLTL IENLTEITTDVEKIQEIRYRSKLKLIRAKEEDSGHYTIVAQNEDAVKSYTFELLTQVPSSILDVDDHHGSTGGQTVRCTAEGTPLPDIEWMICKDKKCNNETSWTILANNVSNIITEIH SRDRSTVEGRVTEAKVEETIAVRCLAKNLLGAENRELKLVAPTLRSELTVAAAVLVLVIVISLVLVIWKQKPRYEIRWRVIESISPDGHEYIYVDPMQLPYDSRWEFPRDGLVLGR VLGSGAFGKVVEGTAYGLSRSQPVMKVAVKMLKPTARSSEKQALMSELKIMTHLGPHLNVNLLGACTKSGPIYIITEYCFYGDLVNYLHKNRDSFLSHHPEKPKKELDFGLNPADE STRSYVILSFENNGDYMDMKQADTTQYVPMLERKEVSKYSDIQRSLYDRPASYKKKSMLDSEVKNLLSDDNSEGLTLDLLSFTYQYARGMEFLASKNCVHRDLAARNVLLAQGKI VKICDFGLARDIMHDSNYVSKGSTFLPVKWMAPESIFDNLYTTLSDVWSYGILLWEIFSLGGTPYPGMMVDSTFYNKIKSGYRMAKPDHATSEYYEIMVKCWNSEPEKRPSFYHL SEIVENLLPGQYKKSYEKIHLDKLSDHPAVARMRVDSDNAVIGVTYKNEEDKLKDWEGGLDEQRLSADSGYIIPLPDIDPVPEEEDLGKRNRHSSQTSEEAIETGSSSTFIKREDET IEDIDMMDDIGIDSSDLVEDSFL |
| PDGFRB | NP_002600 | P09619 | MRLPGAMPALALKGELLLSLLLLLEPQJSQGLVVTPPGPELVLNVSSTFVLTCSGSAPVVWERMSQEPPQEMAKAQDGTFSSVLTLTNLTGLDTGEYFCTHNDSRGLETDERKRLY IFVPDPTVGFLPNDAEELFIFLTEITEITIPCRVTDPQLVVTLHEKKGDVALPVPYDHQRGFSGIFEDRSYICKTTIGDREVDSDAYYVRLQVSSINVSVNAVQTVVRQGENITLMCIVI GNEVVNFEWTYPRKESGRLVEPVTDFLLDMPYHRSILHPSAELEDSGTYTCNVTESVNDHQDEKAINITVVESGYVRLLGEVGTLQFAELHRSRTLQVVFEAYPPPTVLWFKDNR TLGDSSAGEIALSTRNVSETRYVSELTLVRVKVAEAGHYTMRAFHEDAEVQLSFQLQNVPVRVLESESHPDSGEQTVRCRGRGMPQPNIIWSACRDLKRCPRELPPTLLGNSSEE ESQLETNVTYWEEEQEFEVVSTLRLQHVDRPLSVRCTLRNAVGQDTQEVIVVPHSLPFKVVISAILALVLTHSLILILIMLWQKKPRYEIRWKVIESVSSDGHEYIYVDPMQLPYDST WELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSD KRRPPSAELYSNALPVGLPLPSHVSLTGESDGGYMDMSKDESVDYPMLDMKDGVKYADIESSNYMAPYDNYVPSAAPERTCRATLINESPVLSYMDLVGFSYQVANGMEFLASK NCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEYEIM QKCWEEKFEIRPPFSQLVLLLERLLGEGYKKKYQQVDEEFLRSDHPAILRSDQARLPFGHGLRSPLDTSSVLYTAVQPNEGDNDYIPLPDPKPEVADEGPLEGSPSLASSTLNEVNTSST ISCDSPLEPQDEPEPEQLEQVEPEPELEQLPDSGCPAPRAEAEDSFL |
| AXL | NP_068713 | P30530 | MAWRCPRMGRVPLAWCLALCGWACMAPRGTQAEESPFVGNPGNITGARGLTGTLRCQLQVQGEPPEVHWLRDGQLLELADSTQTQVPLGEDEQDDWIVVSQLRITSQLSD TGQYQCLVFLGHQTFVSQPGYVGLEGLPYFLEEPEDRTVAANTPFNLSCQAQGPPEPVDLLWLQDAVPLATAPGHGPQRSLHPHPTPYHIRVACTSSQGPSSWTHWLPVETPEGVPLGPPEMISA QPRNLHLVSRQPTELEVAWTPGLSGYPLTHCTLQAVLSDDGMGIQAGEPDPPEEPLTSQASVPPHQLRLGSLHPHTPYTFRVCIGVSSVRQETPLLAQGDGVSNLTVCVAAYTAAGDGPWSLPVPLEAWRPGQAQPVHQLVKEPSTPAFSWPWMY VLLGAVVAAACVLILALFLVHRRKETRYGEVFEPTVERGELVVRYRVRKSYSRRTTEATLNSLGISEELKEKLRDVMVDRHKVALGKTLGEGEFGAVMEGQLNQDDSILKVAVKTM KIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMS VCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTEL REDLENTLKALPPAQEPDEILYVNMDEGGGYPEPPGAAGGADPPTQPDPKDSCSCLTAAEVHPAGRYVLCPSTTPSPAQPADRGSPAAPGQEDGA |
| PTK7 | NP_002812 | Q13308 | MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSA NASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAP QDVVVARYEEAMFHCQFSAQPPPSLQMLFEDETPITNRSRPPHLRRATVFANGSLLLTQVRPRNAGIYRCIGQGQRGPPIILEATLHLAEIEDMPLFEPRVFTAGSEERVTCLPPKG LPEPSVVMWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVF KNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNG PQGQRAHVQLTVAVFITFKVEPERTTVYQGHTALLQCEAQGDPKPLIQWKGKDRILDPTKLGPRMHFQNGSLVIHDVAPEDSGRYTCIAGNSCNIKHTEAPLYVVDKVPEESE GPGSPPPYKMIQTIGLSVGAAVAYIIAVLGLMFYCKKRCKAKRLQKQPEGEEPEMECLNGGPLQNGQPSAEIQEEVALTLSLGSSGPAATNKRHSTSDKMHFPRSSLQPITTLGKSEF GEVFLAKAQGLEEGVAETLLVLVKSLQSKDEQQOLDFRRELEMFGKLNHANVVRLLGLCREAEPHYMVLEYVDLGDLKOFLRISKSKDEKLKSQPLSTKQKVALCTQVALGMEHLSN NRFVHKDLAARNCLVSAQRQVKVSALGLSKDVYNSEYYHFRQAWVPLRWMSPEAILEEGDFSTKSDVWAFGVLMWEVFTHGEMPHGGQADDEVLADLQAGKARLPQPEGCP SKLYRLMQRCWALSPKDRPSFSEIASALGDSTVDSKP |

FIG. 65 (CONT.)

| | | |
|---|---|---|
| RET | NP_066124 | P07949 | MAKATSGAAGLRLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFP LLTVYLKVFLSPTSLREGECQWPGCARVVFSFFNTSFPACCSSLKPRELCFPETRPSFRIRENRPPGTFHQFRLLPVQFLCPNISVAYRLLEGEGLPRCAPDSLEVSTRWALDREQREKY ELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRAT VHDYRLVLNRNLSISENRTMCQLAVLVNDSDFQGPGAGVLLLHFNVSVLPVSLHPSTYSLVSRRARRFAQIGKVCVENCQAFSGINVQYKLHSSGANCSTLGVVTSAEDTSGILFV NDTKALRPKPCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINIC PQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSM ENQJSVDAFKILEDPKWEFPRKNLVLGKTLGEGEFGKVKATAFHLKGRAGYTTVAVKMLKENASPSELRDLLSEFNVLKQVNHPHVIKLYGACSQDGPLLLIVEYAKYGSLRGFLR ESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQS DVWSFGVLLWEIVTLGGNPYPGIPPERLFNLLKTGHRMERPDNCSEEMYRLMLQCWKQEPDKRPVFADISKDLEKMMVKRDYLDLAASTPSDSLIYDDGLSEEETPLVDCNNA PLPRALPSTWIENKLYGMSDPNWPGESPVPLTRADGTNTGFPRYPNDSYVANWMLSPSAAKLMDTFDS |
| ROS1 | NP_002935 | P08922 | MKNIYCLIPKLVNFATLGCLWISVVQCTVLNSCLKSCVTNLGQQLDLGTPHNLSEPCIQGCHFWNSVDQKNCALKCRESCEVGCSSAEGAYEEVLENADLPTAPFASSIGSHNMT LRWKSANFSGVKYIIQMKYAQLLGSWTYKTVSRPSYVVKPLHPFTEYIFRVVWIFTAQLQLYSPPSPSYRTHPHGVPETAPLIRNIESSSPDTVEVSWDPPQFPGGPILGYNLRLISK NQKLDAGTQRTSFQFYSTLPNTIYRFSIAAVNEVGEGPEAESSITTSSAVQQEEQWLFLSRKTSLRKRSLKHLVDEAHCLRLDAIYHNITGISVDVHQQUVYFSEGTLIWAKKAANM SDVSDLRIFYRGSGLISSISIDWLYQRMYFIMDELVCVCDLENCSNIEETPPSISAPQKIVADSYNGVYFYLLRDGIYRADLPVPSGRCAEAVRIVESCTLKDFAIKPQAKRIIYFNDTAQ VFMSTFLDGSASHLILPRIPFADVKSFACENNDFLVTDGKVIFQQDALSFNEFIVGCDLSHEEFGFGNLVIFGSSSQLHPLPGRPQELSVLFGSHQALVQWKPPALAIGANVILISDHE LFELGPSAWQNWTYEVKVSTQDPPEVTHIFLNISGTMLNVPELQSAMKYKVSVRASSPKRPGPWSEPSVGTTLVPASEPFIMAVKEDGLWSKPLNSFGPGEFLSSDIGNVSDMD WYNNSLYYSDTKGDVFVWLLNGTDISENYHLPSIAGAGALAFEWLGHFLYWAGKTYVIQRQSVLTGHTDIVTHVKLLVNDMAVVDSVGGYLYWTTLYSVESTRLNGESSLVLQTQ PWFSGKKVIALTLDLSDGLLYWLVQDSQCIHLYTAVLRGQSTGDTTITEFAAWSTSEISQNALMYYSGRLFWINGFRITTQEIGQKTSVSVLEPARFNQFTHQTSLKLPGNFSFTPK VIPDSYVQESSFRIEGNASSFQILWNGPPAAVDWGVVFYSVEFSAHSKFLASEQHSLPVFTVEGLEPYALFNLSVTPYTYWGKGPKTSLSLRAPETVPSAPENPRIFILPSGKCCNKNEVV VEFRWNKPKHENGVLTKFEIFYNISNQSITNKTCEDWIAVNVTPSVMSFQLEGMSPRCFIAFQVRAFTSKGPGPYADVVKSTTSEINPFPHLJTLLGNKIVFLDMDQNQVVWTFSA ERVISAVCYTADNEMGYYAEGDSLFLLHLHNRSSSELFQDSLVFDITVTIDWISRHLYFALKESQNGMQVFDVDLEHKVKYPREVKIHNRNSTIISFSVYPLLSRLYWTEVSNFGYQ MFYYSIISHTLHRILQPTATNQQONKRNQCSCNVTEFELSGAMAIDTSNLEKPLIYFAKACQEIWAMDLEGCQCWRVITVPAMLAGKTLVSLTVDGDLIYWIITAKDSTQIYQAKKGN GAIVSQVKALRSRHILAYSSVMQPFPDKAFLSLASDTVEPTILNATNTSLTIRLPLAKTNLTWYGITSPPTYLVYYAEVNDRKNSSDLKYRILEFQDSIALIEDLQPFSTYMIQJAVRKNYY SDPLEHLPPGKEIWGKTKNGVPEAVQLINTTVRSDTSLIISWRESHKPNGPKESVRYQLAISHLALIPETPLRQSEFPNGRLTLVTRLSGGNIYVLKVLACHSEEMWCTESHPVTVE MFNTPEKPYSLVPENTSLQFNWKAPLNVNLIRFWVELQKWKYNEFYHVKTSCSQPAYVCNITNLQPYTSYNVRVVVVYKTGENSTLPESFKTKAGVPNKPGIPKLLEGSKNSIQ WEKAEDNGCRITYYILEIRKSTSNNLQNQNLRWKMTFNGSCSSVCTWKSKNLKGIFQFRVVAANNLGFGEVYEGISENJILVGDDFWIPETSFILTIIVGIFLVVTIPLTFVVHHRRLKNQ KSAKEGVTVLINEDKELAELRGLAAGVGLANACYAIHTLPTQEEIENLPAFFPREKLTLRLLGSGAFGEVVEGTAVDILGVGSGEIKVAVKTLKKGSTDQEKIEFLKEAHLMSKFNHPNI LKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKREGELLPVRW MAPESLMDGIFTTQSDVWSFGILIWEILTLGHQPYPAHSNLRLNVTVQTGGRLEPPRNCPDDLWNLMTQCWAQEPDQRPTFHRIQDQLQLFRNFFLNSIYKSRDEANNSGVIN ESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD |
| RYK | NP_002949 | P34925 | MRGAARLGRPGRSCLPGARGLRAPPPPPLLLLLLALLPLLPAPGAAAAPARPPELQSASAGPSVSLYLSEDEVRRLIGLDAELYYVRNDLISHYALSFSLLVPSETNFLHFTWHAKSKV EYKLGFGVDNVLAMDMPQVNISVQGEVPRTLSVFRVELSCTGKVDSEVMILMQLNLTVNSSKNFTVLNFKRRKMCYKKLEEVKTSALDKNTSRTYDPVHAAPTTSTRVFYISVGV CCAVFILVAIILAVLHLHSMKRIELDDSISASSSSOGLSLQPSTQTTQYLRADTPNNATPITSYPTLRIEKNDLRSVTLLEAKGKVKDIAISRERITLKDVLQEGTFGRIFHGILIDEKDPNKE KQAFVKTVKDQOASEIQVTMMLTESCKLRGLHHRNLLPITHVCIEFGEKPMVILPYMNWGNLKLFLRQCKLVEANNPQAISQQDLVHMAIQJACGMSYLARREVIHKDLAARNCVI DDTLQVKITDNALSRDLFPMDYHCLGDNENRPVRWMALESLVNNEFSSASDVWAFGVTLWEIMTLGQTPYVDIDPFEMAAYLKDGYRIAQPINCPDELFAVMACCWALDPEE RPKFQQLVQCLTEFHAALGAYV |

FIG. 65 (CONT.)

| | | |
|---|---|---|
| TEK | NP_000450 | Q02763 | MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRRTM KMRQQASFLPATLTMTVDKGDNVNISFKKVLIKEEDAVIYKNGSFIHSVPRHEVPDILEVHLPHAQPQDAGVSARYIGGNLFTSAFTRLIVRRCEAQKWGPECNHLCTACMNNG VCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCERE GIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHN FAVINISSEPYFGDGPIKSKKLLYKPVNHYEAWQHIQVTNEIVTLNVLEPRTEYELCVQLVRRGEGEGHPGVRRFFTASIGLPPPRGLNLLPKSQTTLNLTWQPIFPSSEDDFYVEV ERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQ YQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPD PTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIA NSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMT CAELYEKLPQGYRLEKPLNCDDEVYDLMRQCWREKPYERPSFAQILVSLNRMLEERKTYVNTTLYEKFTYAGIDCSAEEEA |
| TIE1 | NP_005415 | P35590 | MVWRVPPFLLIPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTR VIYVHNSPGAHLLPDKVTHTVNKGDTAVLSARVHKEKQTDVIMKSNGSYFYTLDWHEAQDGRFLLQLPNVQPPSSGIYSATYLEASPLGSAFFRLIVRGGAGRWGPCTKECPG CLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWH GVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTK QSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLV PGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQAGG AGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSG EETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYG NLLDFLRKSRVLETDPAFAREHGTASTLSSRQLLRFASDAANGMQYLSEKQFIHRDLAARNVLVGENLASKIADFGLSRGEEVVYKKTMGRLPVRWMAIESLNYSVYTTKSDVWSF GVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA |
| TYRO3 | NP_006284 | Q06418 | MALRRSMGRPGLPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRY WCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPF NITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWE EVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVAVKMLKADIIASSDIEEFLREAACMKE TRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKE FDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGC ASKLPVKWLALESLADNLYTVQSDVVWAFGVTMWEIMTRGQTPYAGIENAEIYNYLIGGNRLKQPPECMEDVYDLMYQCWSADPKQRPSFTCLRMELENILGQLSVLSASQDPL YINIERAEEPTAGGSLELPGRDQPYSSGAGDGSGMGAVGGTPSDCRYILTPGGLAELQPGQAEHQPESPLNETQRLLLQQGLLPHSSC |
| DDR1 | NP_001284583 | Q08345 | MGPEALSSLLLLLLVASGDADMKGHFDPAKCRYALGMQDRTIPDSDISASSSWSDSTAARHSRLESSDGDGAWCPAGSVFPKEEEYLQVDLQRLRHLVLVGTQGRHAGGLGKEF SRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQY GGLGQLADGVVGLDDFRKSQELRVWPGGYVGWSNHSFSSGYVEMEFEFDRLRAFQAMQVHCNNMHTLGARLPGGVECRFRRGPAMAWEGEPMRHNLGGNLGDPRARA VSVPLGGRVARFLQCRFLFAGPWLLFSEISFISDVVNNSSPALGGTFPPAPWWPPGPPTNFSSLELEPRGQQPVAKAEGSPTAILIGCLVAIILLLLIIALMLWRLLSKAER RVLEEELTVHLSVPGDTILINNRPGPREPPYQEPRPRGNPPHSAPCVPNGSALLLSNPAYRLLATYARPPRGPGPPTPAWAKPTNTQAYSGDYMEPEKPGAPLLPPPQNSVPH YAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNII RLLGVCVQDDPLCMITDYMENGDLNQFLSAHQLEDKAAEGAPGDGQAAQPTISYPMLLHVAAQIASGMRYLATLNFVHRDLATRNCLVGENFTIKIADFGMSRNLYAGDYYR VQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDAL NTV |

FIG. 65 (CONT.)

| AATK | NP_0010 73864 | Q6ZMQ8 | MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLK STDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQ RMACEVACGVLHLHRNNFVHSDLALRNCLLTADLTVKIGDYGLAHCKYREDYFVTADQLWVPLRWIAPELVDEVHSNLLVDQTKSGNVWSLGVTIWELFELGTQPYPQHSDQ QVLAYTVREQQLKLPKPQLQLTLSDRWVEVMQFCWLQPEQRPTAEEVHLLLSYLCAKGATEAEEFERRWSLRPGGGVGPGPGAAGPMLGGVVELAAASSFPLLEQFAGDG FHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASL AMEPLLGHGPPVDVPWGRGDHYPRRSLARDPLCPSRSPSAGPLSLAEGGAEDADWGVAAFCPAFFEDPLGTSPLGSSGAPPLLTGEDELEEVGARRAAQRGHWRSNVSAN NNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSV PSPSQEGAPLPSEEASAPDAPDALPDSPTPATGGEVSAJKLASALNGSSSSPEVEAPSSEDEDTAEATSGIFTDTSSDGLQARRPDVVPAFRSLQKQVGTPDSLDSLDIPSSASDGGYE VFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGELGLPSTGQPSE QVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPA ALEGRPEEEEEDSEDSDESDEELRCYSVQEPSEDSEEEAPAVPVVVAESQSARNLRSLLKMPSLLSETFCEDLERKKAVSFFDDVTVYLFDQESPTRELGEPFPGAKESPPTFLRGSP GSPSAPNRPQQADGSPNGSTAEEGGGFAWDDDFPLMTAKAAFAMALDPAAPAPAAPTPTPAPFSRFTVSPAPTSRFSTHVSDSDAESKRGPEAGAGGESKEA |

CONDITIONALLY ACTIVE HETERODIMERIC POLYPEPTIDES AND METHODS OF USE THEREOF

CROSS-REFERENCE

This application is a continuation of PCT/US2017/012634, filed Jan. 6, 2017, which claims the benefit of U.S. Provisional Patent Application No. 62/276,725, filed Jan. 8, 2016, each of which applications is incorporated herein by reference in its entirety.

STATEMENT REGARDING FEDERALLY SPONSORED RESEARCH

This invention was made with government support under Grant Nos. R01 CA196277, P50 GM081879, and R01 GM055040 awarded by the National Institutes of Health. The government has certain rights in the invention.

INCORPORATION BY REFERENCE OF SEQUENCE LISTING PROVIDED AS A TEXT FILE

A Sequence Listing is provided herewith as a text file, "UCSF-524WO_seqlist_ST25.txt" created on Jan. 6, 2017 and having a size of 2,005 KB. The contents of the text file are incorporated by reference herein in their entirety.

INTRODUCTION

In cell-based adoptive immunotherapy, immune cells isolated from a patient can be modified to express synthetic proteins that enable the cells to perform new therapeutic functions after they are subsequently transferred back into the patient. Examples of such synthetic proteins are chimeric antigen receptors (CARs) and engineered T cell Receptors (TCR). An example of a currently used CAR is a fusion of an extracellular recognition domain (e.g., an antigen-binding domain), a transmembrane domain, and one or more intracellular signaling domains. Upon antigen engagement, the intracellular signaling portion of the CAR can initiate an activation-related response in an immune cell, such as release of cytolytic molecules to induce tumor cell death, etc. However, such CARs are not capable of being pharmacologically controlled. Safe human testing and clinical use of such CARs and engineered TCR requires fine control of the powerful stimulating activity of these highly engineered proteins and protein complexes. In some cases, control is required in order to inhibit, halt or otherwise modulate immune cell activation when activation from the designer stimulating receptor is unwanted, becomes undesirable or is no longer necessary.

SUMMARY

The present disclosure provides conditionally active, heterodimeric polypeptides. The conditionally active, heterodimeric polypeptides are active in the presence of a dimerizing agent that induces dimerization of the polypeptides of the heterodimer. A conditionally active, heterodimeric polypeptide of the present disclosure is useful in a variety of research and treatment methods, which are also provided.

The present disclosure provides a heterodimeric, conditionally active polypeptide comprising: a) a first chimeric polypeptide comprising a first member of a dimerization pair and a first heterologous polypeptide; and b) a second chimeric polypeptide comprising a second member of a dimerization pair and a second heterologous polypeptide, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the first chimeric polypeptide and the second chimeric polypeptide are dimerized in the presence of a dimerization agent that induces binding of the LBD to the co-regulator. In some cases, a) the first heterologous polypeptide is a T-cell receptor (TCR) alpha chain; and b) the second heterologous polypeptide is a TCR beta chain. In some cases: a) the first heterologous polypeptide is a first polypeptide of a chimeric antigen receptor (CAR) heterodimer; and b) the second heterologous polypeptide is a second polypeptide of a CAR heterodimer. In some cases: a) the first heterologous polypeptide is an N-terminal portion of an RNA-guided endonuclease; and b) the second heterologous polypeptide is a C-terminal portion of the RNA-guided endonuclease, wherein dimerization of the first chimeric polypeptide and the second chimeric polypeptide, mediated by the dimerization agent that induces binding of the LBD to the co-regulator, restores enzymatic function of the RNA-guided endonuclease. In some cases, the RNA-guided endonuclease is a class 2 CRISPR/Cas endonuclease. In some cases, the class 2 CRISPR/Cas endonuclease is a type II CRISPR/Cas protein, a type V CRISPR/Cas protein, or a type VI CRISPR/Cas protein. In some cases: a) the first heterologous polypeptide is an N-terminal portion of an enzyme; and b) the second heterologous polypeptide is a C-terminal portion of the enzyme, wherein dimerization of the first chimeric polypeptide and the second chimeric polypeptide restore enzymatic activity of the enzyme. In some cases, the enzyme is a kinase, a protease, a phosphatase, or a caspase. In some cases, the first polypeptide and the second polypeptide exhibit an activity when brought into proximity upon dimerization mediated by the dimerization agent, but do not exhibit the activity individually. In some cases: a) the first heterologous polypeptide is an N-terminal portion of an antigen receptor; and b) the second heterologous polypeptide is a C-terminal portion of the antigen receptor, wherein dimerization of the first chimeric polypeptide and the second chimeric polypeptide restore signaling activity of the antigen receptor. In some cases: a) the first heterologous polypeptide is an N-terminal portion of a receptor; and b) the second heterologous polypeptide is a C-terminal portion of the antigen receptor, wherein dimerization of the first chimeric polypeptide and the second chimeric polypeptide mediated by the dimerization agent restores signaling activity of the receptor. In some cases, the LBD of the nuclear hormone binding member of the dimerization pair is an LBD of a nuclear hormone receptor selected from an estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is selected from: a) SRC1: CPSSHSSLTERHKILHRLLQEGSPS (SEQ ID NO:1); b) SRC1-2: SLTARHKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFADPASNLGLEDIIRKALMGSF (SEQ ID NO:8); i) NR0B1: PRQGSILYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKHKILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLLDRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDNPAQDF (SEQ ID NO:35); jj) ASC2-1: DVTLTSPLLVNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFNCLTH (SEQ ID NO:42); qq) ARA70-2: GSRETSEKFKLLFQSYNVNDW (SEQ ID NO:43); rr) TIF1: NANYPRSILTSLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKCCIDL (SEQ ID NO:49); xx) LCoR: AATTQNPVLSKLLMADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAPLPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKKSKVKDQ (SEQ ID NO:58); ggg) RIP140-4: KPSVACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELLDESQKVMV (SEQ ID NO:65); nnn) PRIC285-2: YENLPPAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDVLAGLLLRRMELKP (SEQ ID NO:69).

The present disclosure provides a heterodimeric, conditionally active receptor comprising: a) a first chimeric polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second chimeric polypeptide comprising: i) a transmembrane domain; ii) a second modulatory domain; iii) a second member of the dimerization pair; and iv) an intracellular signaling domain; or comprising: a) a first chimeric polypeptide comprising: i) a first member of a specific binding pair; ii) a modulatory domain; iii) a first member of a dimerization pair; iv) a transmembrane domain interposed between the first member of a specific binding pair and the modulatory domain; and b) a second chimeric polypeptide comprising: i) a second member of the dimerization pair; and ii) an intracellular signaling domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor, wherein the first chimeric polypeptide and the second chimeric polypeptide are dimerized in the presence of a dimerizer that induces binding of the LBD to the co-regulator. In some cases, the first polypeptide comprises a hinge region interposed between the first member of the specific binding pair and the transmembrane domain. In some cases, the first member of the specific binding pair is an antibody or antibody fragment, a ligand, a receptor, or a non-antibody-based recognition scaffold. In some cases, the hinge region is an immunoglobulin IgG hinge region or a hinge derived from CD8. In some cases, the first and second modulatory domains are selected from 4-1BB (CD137), CD28, ICOS, BTLA, OX-40, CD27, CD30, GITR, HVEM, DAP10, DAP12, and CD28. In some cases, the intracellular signaling domain is selected from ZAP70 and CD3-zeta. In some cases, the intracellular signaling domain comprises an immunoreceptor tyrosine-based activation motif (ITAM). In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is a peptide selected from a) SRC1: CPSSHSSLTERH-KILHRLLQEGSPS (SEQ ID NO:1); b) SRC1-2: SLTAR-HKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFADPASNLGLE-DIIRKALMGSF (SEQ ID NO:8); i) NR0B1: PRQGSI-LYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKH-KILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLL-DRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDN-PAQDF (SEQ ID NO:35); jj) ASC2-1: DVTLTSPLL-VNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFN-CLTH (SEQ ID NO:42); qq) ARA70-2: GSRETSEKFKLL-FQSYNVNDW (SEQ ID NO:43); rr) TIF1: NANYPRSILT-SLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKC-CIDL (SEQ ID NO:49); xx) LCoR: AATTQNPVLSKLL-MADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAP-LPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKK-SKVKDQ (SEQ ID NO:58); ggg) RIP140-4: KPS-VACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELL-DESQKVMV (SEQ ID NO:65); nnn) PRIC285-2: YENLP-PAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDV-LAGLLLRRMELKP (SEQ ID NO:69). In some cases: i) the first and second modulatory domains are derived from 4-1BB; ii) the first and second members of the dimerization pair are PPARγ and SRC3; and ii) the signaling domain comprises an ITAM. In some cases, the first member of the specific binding pair is a single-chain Fv. In some cases, the first member of the specific binding pair binds an epitope present on a cell, on a solid surface, or a lipid bilayer. In some cases, the cell is a cancer cell. In some cases, the intracellular signaling domain is an intracellular inhibitory domain. In some cases, the intracellular inhibitory domain is derived from a protein selected from the group consisting of: PD-1, CTLA4, HPK1, SHP1, SHP2, Sts1, and Csk.

The present disclosure provides a heterodimeric, conditionally repressible synthetic immune cell receptor (ICR) comprising: a synthetic stimulatory ICR comprising a first member of a dimerization pair linked to the synthetic stimulatory ICR; and a synthetic ICR repressor comprising a second member of the dimerization pair linked to an intracellular inhibitory domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor, wherein the synthetic stimulatory ICR and the synthetic ICR repressor are dimerized in the presence of a dimerizer that induces binding of the LBD to the co-regulator. In some cases, the synthetic stimulatory ICR comprises an intracellular co-stimulatory domain. In some cases, the intracellular co-stimulatory domain is selected from the group consisting of: 4-1BB (CD137), CD28, ICOS, OX-40, BTLA, CD27, CD30, GITR, and HVEM. In some cases, the first member of a dimerization pair is linked intracellularly to the synthetic stimulatory ICR and the second member of the dimerization pair is linked intracellularly to the intracellular inhibitory domain. In some cases, the synthetic ICR repressor further comprises a transmembrane domain. In some cases, the second member of the dimerization pair is linked intracellularly to the transmembrane domain. In some cases, the second member of the dimerization pair is extracellular and linked to the intracellular inhibitory domain by way of the transmembrane domain. In some cases, the stimulatory ICR binds a soluble antigen. In some cases, the stimulatory ICR binds a cell surface antigen. In some cases, the intracellular inhibitory domain is an inhibitory domain derived from a protein selected from the group consisting of: PD-1, CTLA4, HPK1, SHP1, SHP2, Sts1 and Csk. In some cases, the synthetic stimulatory ICR comprises an intracellular signaling domain selected from the group consisting of: a CD3-zeta signaling domain, a ZAP70 signaling domain and an immunoreceptor tyrosine-based activation motif (ITAM). In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is selected from: a) SRC1: CPSSHSSLTERH-KILHRLLQEGSPS (SEQ ID NO:1); b) SRC1-2: SLTAR-HKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFADPASNLGLE-DIIRKALMGSF (SEQ ID NO:8); i) NR0B1: PRQGSI-LYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKH-KILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLL-DRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDN-PAQDF (SEQ ID NO:35); jj) ASC2-1: DVTLTSPLL-VNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFN-CLTH (SEQ ID NO:42); qq) ARA70-2: GSRETSEKFKLL-FQSYNVNDW (SEQ ID NO:43); rr) TIF1: NANYPRSILT-SLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKC-CIDL (SEQ ID NO:49); xx) LCoR: AATTQNPVLSKLL-MADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAP-LPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKK-SKVKDQ (SEQ ID NO:58); ggg) RIP140-4: KPS-VACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELL-DESQKVMV (SEQ ID NO:65); nnn) PRIC285-2: YENLP-PAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDV-LAGLLLRRMELKP (SEQ ID NO:69). In some cases, the synthetic stimulatory ICR is a synthetic chimeric antigen receptor (CAR) or portion thereof. In some cases, the synthetic stimulatory ICR is a synthetic T cell receptor (TCR) or portion thereof.

The present disclosure provides a heterodimeric, conditionally repressible synthetic chimeric antigen receptor (CAR) comprising: a) a synthetic stimulatory CAR comprising: i) a extracellular recognition domain; ii) a transmembrane domain linked to the extracellular recognition domain; iii) a first member of a dimerization pair linked to the transmembrane domain; and iv) an intracellular stimulation domain; and b) a synthetic CAR repressor comprising: i) a second member of the dimerization pair; and ii) an intracellular inhibitory domain linked to the second member of the dimerization pair, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the synthetic stimulatory CAR and the synthetic CAR repressor are dimerized in the presence of a ligand that induces binding of the LBD to the co-regulator. In some cases, the synthetic CAR repressor further comprises a transmembrane domain linked to the second member of the dimerization pair, the intracellular inhibitory domain or both. In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is selected from: a) SRC1: CPSSHSSLTERHKILHRLLQEGSPS (SEQ ID NO:1); b) SRC1-2: SLTARHKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFAD-PASNLGLEDIIRKALMGSF (SEQ ID NO:8); i) NR0B1: PRQGSILYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKHKILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLL-DRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDNPAQDF (SEQ ID NO:35); jj) ASC2-1: DVTLTSPLL-VNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFN-CLTH (SEQ ID NO:42); qq) ARA70-2: GSRETSEKFKLL-FQSYNVNDW (SEQ ID NO:43); rr) TIF1: NANYPRSILT-SLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKC-CIDL (SEQ ID NO:49); xx) LCoR: AATTQNPVLSKLL-MADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAP-LPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKK-SKVKDQ (SEQ ID NO:58); ggg) RIP140-4: KPS-VACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELL-DESQKVMV (SEQ ID NO:65); nnn) PRIC285-2: YENLP-PAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDV-LAGLLLRRMELKP (SEQ ID NO:69).

The present disclosure provides a heterodimeric, conditionally repressible synthetic T cell receptor (TCR) comprising: a) a synthetic stimulatory TCR comprising: i) a transmembrane domain; ii) a first member of a dimerization pair linked to the transmembrane domain; iii) an engineered TCR polypeptide comprising at least one TCR alpha or beta chain, wherein the at least one TCR alpha or beta chain is linked to the transmembrane domain or the first member of a dimerization pair; and b) a synthetic TCR repressor comprising: i) a second member of the dimerization pair; and ii) an intracellular inhibitory domain linked to the second member of the dimerization pair, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the synthetic stimulatory TCR and the synthetic TCR repressor are dimerized in the presence of a dimerization agent that induces binding of the LBD to the co-regulator. In some cases, the synthetic TCR repressor further comprises a transmembrane domain linked to the second member of the dimerization pair, the intracellular inhibitory domain or both. In some cases, the engineered TCR polypeptide further comprises a TCR gamma chain. In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is selected from: a) SRC1: CPSSHSSLTERH-KILHRLLQEGSPS (SEQ ID NO:1); b) SRC1-2: SLTAR-HKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFADPASNLGLE-DIIRKALMGSF (SEQ ID NO:8); i) NR0B1: PRQGSI-LYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKH-KILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLL-DRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDN-PAQDF (SEQ ID NO:35); jj) ASC2-1: DVTLTSPLL-VNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFN-CLTH (SEQ ID NO:42); qq) ARA70-2: GSRETSEKFKLL-FQSYNVNDW (SEQ ID NO:43); rr) TIF1: NANYPRSILT-SLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKC-CIDL (SEQ ID NO:49); xx) LCoR: AATTQNPVLSKLL-MADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAP-LPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKK-SKVKDQ (SEQ ID NO:58); ggg) RIP140-4: KPS-VACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELL-DESQKVMV (SEQ ID NO:65); nnn) PRIC285-2: YENLP-PAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDV-LAGLLLRRMELKP (SEQ ID NO:69).

The present disclosure provides a heterodimeric, conditionally active chimeric antigen receptor (CAR) comprising: a) a first polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second polypeptide comprising: i) a transmembrane domain; ii) a second modulatory domain; iii) a second member of the dimerization pair; and iv) an intracellular signaling domain; or comprising: a) a first polypeptide comprising: i) a first member of a specific binding pair; ii) a modulatory domain; iii) a first member of a dimerization pair; iv) a transmembrane domain interposed between the first member of a specific binding pair and the modulatory domain; and b) a second polypeptide comprising: i) a second member of the dimerization pair; and ii) an intracellular signaling domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the first polypeptide and the second polypeptide are dimerized in the presence of a dimerizing agent that induces binding of the LBD to the co-regulator. In some cases, the first polypeptide comprises a hinge region interposed between the first member of the specific binding pair and the transmembrane domain. In some cases, the first member of the specific binding pair is an antibody or antibody fragment, a ligand, or a receptor. In some cases, the hinge region is an immunoglobulin IgG hinge region or a hinge derived from CD8. In some cases, the first and second modulatory domains are selected from 4-1BB (CD137), CD28, ICOS, BTLA, OX-40, CD27, CD30, GITR, HVEM, DAP10, DAP12, and CD28. In some cases, the intracellular signaling domain is selected from ZAP70 and CD3-zeta. In some cases, the intracellular signaling domain comprises an immunoreceptor tyrosine-based activation motif (ITAM). In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor. In some cases, the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285. In some cases, the co-regulator of the nuclear hormone receptor is selected from: a) SRC1: CPSSHSSLTERH-KILHRLLQEGSPS (SEQ ID NO:1); b) SRC1-2: SLTAR-HKILHRLLQEGSPSDI (SEQ ID NO:2); c) SRC3-1: ESKGHKKLLQLLTCSSDDR (SEQ ID NO:3); d) SRC3: PKKENNALLRYLLDRDDPSDV (SEQ ID NO:4); e) PGC-1: AEEPSLLKKLLLAPANT (SEQ ID NO:5); f) PGC1a: QEAEEPSLLKKLLLAPANTQL (SEQ ID NO:6); g) TRAP220-1: SKVSQNPILTSLLQITGNGGS (SEQ ID NO:7); h) NCoR (2051-2075): GHSFADPASNLGLE-DIIRKALMGSF (SEQ ID NO:8); i) NR0B1: PRQGSI-LYSMLTSAKQT (SEQ ID NO:9); j) NRIP1: AANNSLLLHLLKSQTIP (SEQ ID NO:10); k) TIF2: PKKKENALLRYLLDKDDTKDI (SEQ ID NO:11); l) CoRNR Box: DAFQLRQLILRGLQDD (SEQ ID NO:12); m) αβV: SPGSREWFKDMLS (SEQ ID NO:13); n) TRAP220-2: GNTKNHPMLMNLLKDNPAQDF (SEQ ID NO:14); o) EA2: SSKGVLWRMLAEPVSR (SEQ ID NO:15); p) TA1: SRTLQLDWGTLYWSR (SEQ ID NO:16); q) EAB1: SSNHQSSRLIELLSR (SEQ ID NO:17); r) SRC2: LKEKHKILHRLLQDSSSPV (SEQ ID NO:18); s) SRC1-3: QAQQKSLLQQLLTE (SEQ ID NO:19); t) SRC1-1: KYSQTSHKLVQLLTTTAEQQL (SEQ ID NO:20); u) SRC1-2: SLTARHKILHRLLQEGSPSDI (SEQ ID NO:21); v) SRC1-3: KESKDHQLLRYLLDKDEKDLR (SEQ ID NO:22); w) SRC1-4a: PQAQQKSLLQQLLTE (SEQ ID NO:23); x) SRC1-4b: PQAQQKSLRQQLLTE (SEQ ID NO:24); y) GRIP1-1: HDSKGQTKLLQLLTTKSDQME (SEQ ID NO:25); z) GRIP1-2: SLKEKH-KILHRLLQDSSSPVD (SEQ ID NO:26); aa) GRIP1-3: PKKKENALLRYLLDKDDTKDI (SEQ ID NO:27); bb) AIB1-1: LESKGHKKLLQLLTCSSDDRG (SEQ ID NO:28); cc) AIB1-2: LLQEKHRILHKLLQNGNSPAE (SEQ ID NO:29); dd) AIB1-3: KKKENNALLRYLL-DRDDPSDA (SEQ ID NO:30); ee) PGC1a: QEAEEPSLLKKLLLAPANTQL (SEQ ID NO:31); ff) PGC1b: PEVDELSLLQKLLLATSYPTS (SEQ ID NO:32); gg) PRC: VSPREGSSLHKLLTLSRTPPE (SEQ ID NO:33); hh) TRAP220-1: SKVSQNPILTSLLQITGNGGS (SEQ ID NO:34); ii) TRAP220-2: GNTKNHPMLMNLLKDN-PAQDF (SEQ ID NO:35); jj) ASC2-1: DVTLTSPLL-VNLLQSDISAGH (SEQ ID NO:36); kk) ASC2-2: AMREAPTSLSQLLDNSGAPNV (SEQ ID NO:37); ll) CBP-1: DAASKHKQLSELLRGGSGSSI (SEQ ID NO:38); mm) CBP-2: KRKLIQQQLVLLLHAHKCQRR (SEQ ID NO:39); nn) P300: DAASKHKQLSELLRSGSSPNL (SEQ ID NO:40); oo) CIA: GHPPAIQSLINLLADNRYLTA (SEQ ID NO:41); pp) ARA70-1: TLQQQAQQLYSLLGQFN-CLTH (SEQ ID NO:42); qq) ARA70-2: GSRETSEKFKLL-FQSYNVNDW (SEQ ID NO:43); rr) TIF1: NANYPRSILT-SLLLNSSQSST (SEQ ID NO:44); ss) NSD1: IPIEPDYKFSTLLMMLKDMHD (SEQ ID NO:45); tt) SMAP: ATPPPSPLLSELLKKGSLLPT (SEQ ID NO:46); uu) Tip60: VDGHERAMLKRLLRIDSKCLH (SEQ ID NO:47); vv) ERAP140: HEDLDKVKLIEYYLTKNKEGP (SEQ ID NO:48); ww) Nix1: ESPEFCLGLQTLLSLKC-CIDL (SEQ ID NO:49); xx) LCoR: AATTQNPVLSKLL-MADQDSPL (SEQ ID NO:50); yy) CoRNR1 (N-CoR): MGQVPRTHRLITLADHICQIITQDFARNQV (SEQ ID NO:51); zz) CoRNR2 (N-CoR): NLGLEDIIRKALMG (SEQ ID NO:52); aaa) CoRNR1 (SMRT): APGVKGHQRVVTLAQHISEVITQDTYRHHPQQLSAP-LPAP (SEQ ID NO:53); bbb) CoRNR2 (SMRT): NMGLEAIIRKALMG (SEQ ID NO:54); ccc) RIP140-C: RLTKTNPILYYMLQKGGNSVA (SEQ ID NO:55); ddd) RIP140-1: QDSIVLTYLEGLLMHQAAGGS (SEQ ID NO:56); eee) RIP140-2: KGKQDSTLLASLLQSFSSRLQ (SEQ ID NO:57); fff) RIP140-3: CYGVASSHLKTLLKK-SKVKDQ (SEQ ID NO:58); ggg) RIP140-4: KPS-VACSQLALLLSSEAHLQQ (SEQ ID NO:59); hhh) RIP140-5: KQAANNSLLLHLLKSQTIPKP (SEQ ID NO:60); iii) RIP140-6: NSHQKVTLLQLLLGHKNEENV (SEQ ID NO:61); jjj) RIP140-7: NLLERRTVLQLLLGNPTKGRV (SEQ ID NO:62); kkk) RIP140-8: FSFSKNGLLSRLLRQNQDSYL (SEQ ID NO:63); lll) RIP140-9: RESKSFNVLKQLLLSENCVRD (SEQ ID NO:64); mmm) PRIC285-1: ELNADDAILRELL-DESQKVMV (SEQ ID NO:65); nnn) PRIC285-2: YENLP-PAALRKLLRAEPERYR (SEQ ID NO:66); ooo) PRIC285-3: MAFAGDEVLVQLLSGDKAPEG (SEQ ID NO:67); ppp) PRIC285-4: SCCYLCIRLEGLLAPTASPRP (SEQ ID NO:68); and qqq) PRIC285-5: PSNKSVDV-LAGLLLRRMELKP (SEQ ID NO:69). In some cases, the first member of the specific binding pair is a single-chain Fv. In some cases, the first member of the specific binding pair binds an epitope present on a cell, on a solid surface, or a lipid bilayer. In some cases, the cell is a cancer cell.

The present disclosure provides a mammalian cell genetically modified to produce the heterodimeric, conditionally active polypeptide or receptor as described above or elsewhere herein. In some cases, the cell is a stem cell, a progenitor cell, or a cell derived from a stem cell or a progenitor cell. In some cases, the cell is a T lymphocyte or an NK cell.

The present disclosure provides a nucleic acid comprising nucleotide sequences encoding the heterodimeric, conditionally active receptor or polypeptide as described above or elsewhere herein. In some cases, the nucleotide sequences are operably linked to a promoter. In some cases, the promoter is an inducible promoter. In some cases, the promoter is a cell type-specific or tissue-specific promoter. In some cases, the promoter is a T lymphocyte-specific promoter or an NK cell-specific promoter. In some cases, the nucleic acid is in vitro transcribed RNA. The present disclosure provides a recombinant expression vector comprising the nucleic acid. In some cases, the recombinant expression vector is a viral vector, e.g., a lentiviral vector, a retroviral vector, or an adeno-associated viral vector.

The present disclosure provides a method of modulating an activity of a eukaryotic cell, the method comprising: a) expressing the heterodimeric, conditionally active polypeptide or receptor as described above, or elsewhere herein, in the eukaryotic cell; and b) contacting the cell with the ligand.

The present disclosure provides a method of modulating an activity of a T lymphocyte, the method comprising contacting the T lymphocyte with a dimerizing agent and a second member of a specific binding pair, wherein the T lymphocyte is genetically modified to produce a heterodimeric, conditionally active receptor as described above, or elsewhere herein, and wherein, in the presence of the dimerizing agent and the second member of a specific binding pair, the heterodimeric, conditionally active receptor dimerizes and modulates an activity of the T lymphocyte, thereby producing a modulated T lymphocyte. In some cases, the second member of a specific binding pair is an antigen. In some cases, the contacting occurs in vivo. In some cases, the T lymphocyte is activated, thereby producing an activated T lymphocyte. In some cases, the activated T lymphocyte mediates killing of a target cell. In some cases, the activated T lymphocyte produces IL-2 and/or IFN-γ. In some cases, the target cell is a cancer cell.

The present disclosure provides a method of making the cell of any one of claims 66-68, the method comprising genetically modifying a mammalian cell with an expression vector comprising nucleotide sequences encoding the heterodimeric, conditionally active receptor or polypeptide as described above or elsewhere herein, or genetically modifying a mammalian cell with an RNA comprising nucleotide sequences encoding the heterodimeric, conditionally active receptor as described above or elsewhere herein. In some cases, the genetic modification is carried out ex vivo. In some cases, the cell is a T lymphocyte, a stem cell, an NK cell, a progenitor cell, a cell derived from a stem cell, or a cell derived from a progenitor cell.

The present disclosure provides a method of treating a cancer in an individual, the method comprising: i) genetically modifying T lymphocytes obtained from the individual with an expression vector comprising nucleotide sequences encoding the heterodimeric, conditionally active chimeric antigen receptor (CAR) as described above or elsewhere herein, wherein the antigen-binding domain of the heterodimeric, conditionally active CAR is specific for an epitope on a cancer cell in the individual, and wherein said genetic modification is carried out ex vivo; ii) introducing the genetically modified T lymphocytes into the individual; and iii) administering to the individual an effective amount of a dimerizing agent, wherein the dimerizing agent induces dimerization of the heterodimeric, conditionally active receptor, wherein said dimerization provides for activation of the genetically modified T lymphocytes and killing of the cancer cell, thereby treating the cancer. In some cases, the dimerizing agent is a nuclear hormone that binds the LBD of the nuclear hormone receptor and the co-regulator.

The present disclosure provides a method of modulating the activity of a host cell, the method comprising contacting the host cell with a dimerizing agent and a second member of a specific binding pair, wherein the T lymphocyte is genetically modified to produce a heterodimeric, conditionally active receptor as described above or elsewhere herein, and wherein, in the presence of the dimerizing agent and the second member of a specific binding pair, the heterodimeric, conditionally active receptor dimerizes and modulates at least one activity of the host cell. In some cases, the activity is proliferation, cell survival, apoptosis, gene expression, or immune activation. In some cases, the second member of a specific binding pair is an antigen.

BRIEF DESCRIPTION OF THE DRAWINGS

FIG. 1A-1F depict amino acid sequences of mineralocorticoid receptors (MR). FIG. 1A: full-length MR amino acid sequence; FIG. 1B-1E: amino acid sequences of ligand-binding domain (LBD) of MR; FIG. 1F: multiple sequence alignment of LBD of MR of various species. (SEQ ID NOs:70-84).

FIG. 2A-2I depict amino acid sequences of androgen receptors (AR). FIG. 2A: full-length AR amino acid sequence; FIG. 2B-2I: amino acid sequences of LBD of AR. (SEQ ID NOs:85-93).

FIG. 3A-3D depict amino acid sequences of progesterone receptors (PR). FIG. 3A: full-length PR amino acid sequence; FIG. 3B-3C: amino acid sequences of LBD of PR; FIG. 3D: multiple sequence alignment of LBD of PR of various species. (SEQ ID NOs:94-103).

FIG. 4A-4D depict amino acid sequences of thyroid hormone receptor-beta (TRβ). FIG. 3A: full-length PR amino acid sequence; FIG. 3B-3C: amino acid sequences of LBD of TRβ; FIG. 3D: multiple sequence alignment of LBD of TRβ of various species. (SEQ ID NO:104-118).

FIG. 5A-5H depict amino acid sequences of estrogen receptor-alpha (ERα). FIG. 5A: full-length ERα amino acid sequence; FIG. 5B-5G: amino acid sequences of LBD of ERα; FIG. 5H; multiple sequence alignment of LBD of ERα of various species. (SEQ ID NO:119-133).

FIG. 6A-6C depict amino acid sequences of estrogen receptor-beta (ERβ). FIG. 6A: full-length ERβ amino acid sequence; FIG. 6B: amino acid sequence of LBD of ERβ; FIG. 6C; multiple sequence alignment of LBD of ERβ of various species. (SEQ ID NO:134-143).

FIG. 7A-7E depict amino acid sequences of peroxisome proliferator-activated receptor-gamma (PPAR-γ). FIG. 7A: full-length PPAR-γ amino acid sequence; FIG. 7B-7D: amino acid sequences of LBD of PPAR-γ; FIG. 7E: multiple sequence alignment of LBD of PPAR-γ of various species. (SEQ ID NOs:144-157).

FIG. 8A-8C depict amino acid sequences of glucocorticoid receptor (GR). FIG. 8A: full-length GR amino acid sequence; FIG. 8B: amino acid sequence of LBD of GR; FIG. 8C; multiple sequence alignment of LBD of GR of various species. (SEQ ID NOs:158-166).

FIG. 9A-9C depict amino acid sequences of vitamin D receptor (VDR). FIG. 9A: full-length VDR amino acid sequence; FIG. 9B: amino acid sequence of LBD of VDR; FIG. 9C; multiple sequence alignment of LBD of VDR of various species. (SEQ ID NOs:167-172).

FIG. 10A-10C depict amino acid sequences of thyroid hormone receptor-alpha (TRα). FIG. 10A: full-length TRα amino acid sequence; FIG. 10B: amino acid sequence of LBD of TRα; FIG. 10C; multiple sequence alignment of LBD of TRα of various species. (SEQ ID NOs:173-185).

FIG. 11A-11C depict amino acid sequences of retinoic acid receptor-beta (RARβ). FIG. 11A: full-length RARβ amino acid sequence; FIG. 11B: amino acid sequence of LBD of RARβ; FIG. 11C; multiple sequence alignment of LBD of RARβ of various species. (SEQ ID NOs:186-196).

FIG. 19 provides a table showing various possible combinations of LBD, co-regulator, and dimerization agent.

FIG. 20A-20C depict amino acid sequences of Lyn kinase (FIG. 20A), an N-terminal portion of a Lyn kinase (FIG. 20B), and a C-terminal portion of a Lyn kinase (FIG. 20C). (SEQ ID NOs:197-199)

FIG. 21 provides an amino acid sequence of a Fak kinase. (SEQ ID NO:200)

FIG. 22A-22B depict amino acid sequences of an FXR (FIG. 22A) and a LBD of an FXR (FIG. 22B). (SEQ ID NOs:201-202)

FIG. 23A-23B depict amino acid sequences of an LXRα (FIG. 23A) and a LBD of an LXRα (FIG. 23B). (SEQ ID NOs:203-204)

FIG. 24A-24B depict amino acid sequences of an RORγ (FIG. 24A) and a LBD of an RORγ (FIG. 24B). (SEQ ID NOs:205-206)

FIG. 25A-25B depict amino acid sequences of an RXRα (FIG. 25A) and a LBD of an RXRα (FIG. 25B). (SEQ ID NOs:207-208)

FIG. 26A-26B depict amino acid sequences of a PXR (FIG. 26A) and a LBD of a PXR (FIG. 26B). (SEQ ID NOs:209-210)

FIG. 27 provides Table 1 (SEQ ID NOs:211-278).

FIG. 28 provides the amino acid sequence of *S. pyogenes* Cas9 (SEQ ID NO:279).

FIG. 29-51B provide amino acid sequences of various co-regulator polypeptides (SEQ ID NOs:280-302).

FIG. 53 provide the amino acid sequences of exemplary IL-2 family receptors (SEQ ID NOs:303-313).

FIG. 54 provide the amino acid sequences of exemplary IL-3 family receptors (SEQ ID NOs:314-317).

FIG. 55 provide the amino acid sequences of exemplary IL-6 family receptors (SEQ ID NOs:318-326).

FIG. 56 provide the amino acid sequences of exemplary IL-12 family receptors (SEQ ID NOs:327-329).

FIG. 57 provide the amino acid sequences of exemplary prolactin family receptors (SEQ ID NOs:330-334).

FIG. 58 provide the amino acid sequences of exemplary interferon family receptors (SEQ ID NOs:335-338).

FIG. 59 provide the amino acid sequences of exemplary IL-10 family receptors (SEQ ID NOs:339-345).

FIG. 60 provide the amino acid sequences of exemplary IL-17 family receptors (SEQ ID NOs:346-350).

FIG. 61 provide the amino acid sequences of exemplary immunoglobulin-like superfamily receptors (SEQ ID NOs: 351-361).

FIG. 62 provide the amino acid sequences of exemplary tumor necrosis factor family receptors (SEQ ID NOs:362-392).

FIG. 63 provide the amino acid sequences of exemplary chemokine receptors (SEQ ID NOs:393-409).

FIG. 64 provide the amino acid sequences of exemplary TGF-beta family receptors (SEQ ID NOs:410-412).

FIG. 65 provide the amino acid sequences of exemplary receptor tyrosine kinases (RTKs) (SEQ ID NOs:413-469).

DEFINITIONS

Figure 1F:
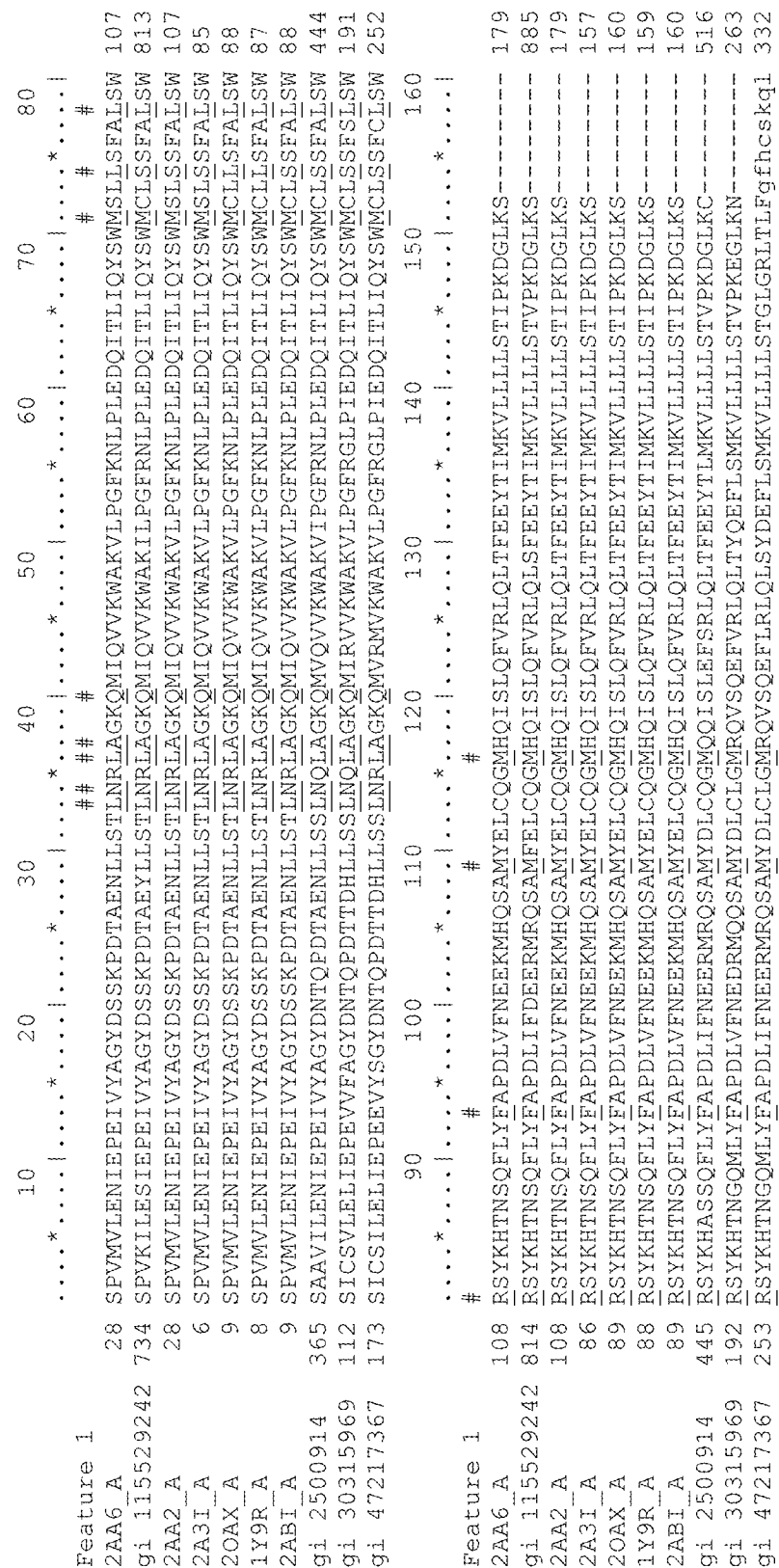

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

"Operably linked" refers to a juxtaposition wherein the components so described are in a relationship permitting them to function in their intended manner. For instance, a promoter is operably linked to a coding sequence if the promoter affects its transcription or expression.

A "vector" or "expression vector" is a replicon, such as plasmid, phage, virus, or cosmid, to which another DNA segment, i.e. an "insert", may be attached so as to bring about the replication of the attached segment in a cell.

Heterologous," as used herein, means a nucleotide or polypeptide sequence that is not found in the native (e.g., naturally-occurring) nucleic acid or protein, respectively.

The terms "antibodies" and "immunoglobulin" include antibodies or immunoglobulins of any isotype, fragments of antibodies that retain specific binding to antigen, including, but not limited to, Fab, Fv, scFv, and Fd fragments, chimeric antibodies, humanized antibodies, single-chain antibodies (scAb), single domain antibodies (dAb), single domain heavy chain antibodies, a single domain light chain antibodies, bi-specific antibodies, multi-specific antibodies, and fusion proteins comprising an antigen-binding (also referred to herein as antigen binding) portion of an antibody and a non-antibody protein. The antibodies can be detectably labeled, e.g., with a radioisotope, an enzyme that generates a detectable product, a fluorescent protein, and the like. The antibodies can be further conjugated to other moieties, such as members of specific binding pairs, e.g., biotin (member of biotin-avidin specific binding pair), and the like. The antibodies can also be bound to a solid support, including, but not limited to, polystyrene plates or beads, and the like. Also encompassed by the term are Fab', Fv, F(ab')$_2$, and or other antibody fragments that retain specific binding to antigen, and monoclonal antibodies. As used herein, a monoclonal antibody is an antibody produced by a group of identical cells, all of which were produced from a single cell by repetitive cellular replication. That is, the clone of cells only produces a single antibody species. While a monoclonal antibody can be produced using hybridoma production technology, other production methods known to those skilled in the art can also be used (e.g., antibodies derived from antibody phage display libraries). An antibody can be monovalent or bivalent. An antibody can be an Ig monomer, which is a "Y-shaped" molecule that consists of four polypeptide chains: two heavy chains and two light chains connected by disulfide bonds.

The term "humanized immunoglobulin" as used herein refers to an immunoglobulin comprising portions of immunoglobulins of different origin, wherein at least one portion comprises amino acid sequences of human origin. For example, the humanized antibody can comprise portions derived from an immunoglobulin of nonhuman origin with the requisite specificity, such as a mouse, and from immunoglobulin sequences of human origin (e.g., chimeric immunoglobulin), joined together chemically by conventional techniques (e.g., synthetic) or prepared as a contiguous polypeptide using genetic engineering techniques (e.g., DNA encoding the protein portions of the chimeric antibody can be expressed to produce a contiguous polypeptide chain). Another example of a humanized immunoglobulin is an immunoglobulin containing one or more immunoglobulin chains comprising a CDR derived from an antibody of nonhuman origin and a framework region derived from a light and/or heavy chain of human origin (e.g., CDR-grafted antibodies with or without framework changes). Chimeric or CDR-grafted single chain antibodies are also encompassed by the term humanized immunoglobulin. See, e.g., Cabilly et al., U.S. Pat. No. 4,816,567; Cabilly et al., European Patent No. 0,125,023 B1; Boss et al., U.S. Pat. No. 4,816, 397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Padlan, E. A. et al., European Patent Application No. 0,519, 596 A1. See also, Ladner et al., U.S. Pat. No. 4,946,778; Huston, U.S. Pat. No. 5,476,786; and Bird, R. E. et al., Science, 242: 423-426 (1988)), regarding single chain antibodies.

The term "nanobody" (Nb), as used herein, refers to the smallest antigen binding fragment or single variable domain ($V_{HH}$) derived from naturally occurring heavy chain antibody and is known to the person skilled in the art. They are derived from heavy chain only antibodies, seen in camelids (Hamers-Casterman et al., 1993; Desmyter et al., 1996). In the family of "camelids" immunoglobulins devoid of light polypeptide chains are found. "Camelids" comprise old world camelids (*Camelus bactrianus* and *Camelus dromedarius*) and new world camelids (for example, *Llama paccos*, *Llama glama*, *Llama guanicoe* and *Llama vicugna*). A single variable domain heavy chain antibody is referred to herein as a nanobody or a $V_{HH}$ antibody.

"Antibody fragments" comprise a portion of an intact antibody, for example, the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 (1995)); domain antibodies (dAb; Holt et al. (2003) *Trends Biotechnol.* 21:484); single-chain antibody molecules; and multi-specific antibodies formed from antibody fragments. Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen combining sites and is still capable of cross-linking antigen.

"Fv" is the minimum antibody fragment that contains a complete antigen-recognition and -binding site. This region consists of a dimer of one heavy- and one light-chain variable domain in tight, non-covalent association. It is in this configuration that the three CDRS of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The "Fab" fragment also contains the constant domain of the light chain and the first constant domain ($CH_1$) of the heavy chain. Fab fragments differ from Fab' fragments by the addition of a few residues at the carboxyl terminus of the heavy chain $CH_1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these classes can be further divided into subclasses (isotypes), e.g., IgG1, IgG2, IgG3, IgG4, IgA, and IgA2. The subclasses can be further divided into types, e.g., IgG2a and IgG2b.

"Single-chain Fv" or "sFv" or "scFv" antibody fragments comprise the $V_H$ and $V_L$ domains of antibody, wherein these domains are present in a single polypeptide chain. In some embodiments, the Fv polypeptide further comprises a polypeptide linker between the $V_H$ and $V_L$ domains, which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (1993) *Proc. Natl. Acad. Sci. USA* 90:6444-6448.

As used herein, the term "hinge region" refers to a flexible polypeptide connector region (also referred to herein as "hinge" or "spacer") providing structural flexibility and spacing to flanking polypeptide regions and can consist of natural or synthetic polypeptides. A "hinge region" derived from an immunoglobulin (e.g., IgG1) is generally defined as stretching from Glu216 to Pro230 of human IgG1 (Burton (1985) Molec. Immunol., 22:161-206). Hinge regions of other IgG isotypes may be aligned with the IgG1 sequence by placing the first and last cysteine residues forming inter-heavy chain disulfide (S—S) bonds in the same positions. The hinge region may be of natural occurrence or non-natural occurrence, including but not limited to an altered hinge region as described in U.S. Pat. No. 5,677,425. The hinge region can include complete hinge region derived from an antibody of a different class or subclass from that of the CH1 domain. The term "hinge region" can also include regions derived from CD8 and other receptors that provide a similar function in providing flexibility and spacing to flanking regions.

As used herein, the term "affinity" refers to the equilibrium constant for the reversible binding of two agents (e.g., an antibody and an antigen) and is expressed as a dissociation constant ($K_D$). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1,000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more. As used herein, the term "avidity" refers to the resistance of a complex of two or more agents to dissociation after dilution. The terms "immunoreactive" and "preferentially binds" are used interchangeably herein with respect to antibodies and/or antigen-binding fragments.

The term "binding" refers to a direct association between two molecules, due to, for example, covalent, electrostatic, hydrophobic, and ionic and/or hydrogen-bond interactions, including interactions such as salt bridges and water bridges. In some cases, the first member of a specific binding pair present in the extracellular domain of a conditionally active heterodimeric polypeptide of the present disclosure binds specifically to a second member of the specific binding pair. "Specific binding" refers to binding with an affinity of at least about $10^{-7}$ M or greater, e.g., $5 \times 10^{-7}$ M, $10^{-8}$M, $5 \times 10^{-8}$M, and greater. "Non-specific binding" refers to binding with an affinity of less than about $10^{-7}$ M, e.g., binding with an affinity of $10^{-6}$ M, $10^{-5}$ M, $10^{-4}$ M, etc.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

An "isolated" polypeptide is one that has been identified and separated and/or recovered from a component of its natural environment. Contaminant components of its natural environment are materials that would interfere with diagnostic or therapeutic uses for the polypeptide, and may include enzymes, hormones, and other proteinaceous or nonproteinaceous solutes. In some embodiments, the polypeptide will be purified (1) to greater than 90%, greater than 95%, or greater than 98%, by weight of antibody as determined by the Lowry method, for example, more than 99% by weight, (2) to a degree sufficient to obtain at least 15 residues of N-terminal or internal amino acid sequence by use of a spinning cup sequenator, or (3) to homogeneity by sodium dodecyl sulfate-polyacrylamide gel electrophoresis (SDS-PAGE) under reducing or nonreducing conditions using Coomassie blue or silver stain. Isolated polypeptide includes the polypeptide in situ within recombinant cells since at least one component of the polypeptide's natural environment will not be present. In some instances, isolated polypeptide will be prepared by at least one purification step.

The term "module", as used herein, refers to a contiguous polypeptide sequence, or fragment thereof, that is associated with some function, particularly a biological function.

The terms "domain" and "motif", used interchangeably herein, refer to both structured domains having one or more particular functions and unstructured segments of a polypeptide that, although unstructured, retain one or more particular functions. For example, a structured domain may encompass but is not limited to a continuous or discontinuous plurality of amino acids, or portions thereof, in a folded polypeptide that comprise a three-dimensional structure which contributes to a particular function of the polypeptide. In other instances, a domain may include an unstructured segment of a polypeptide comprising a plurality of two or more amino acids, or portions thereof, that maintains a particular function of the polypeptide unfolded or disordered. Also encompassed within this definition are domains that may be disordered or unstructured but become structured or ordered upon association with a target or binding partner. Non-limiting examples of intrinsically unstructured domains and domains of intrinsically unstructured proteins are described, e.g., in Dyson & Wright. *Nature Reviews Molecular Cell Biology* 6:197-208.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term "CAR" is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. *Sci Transl Med* (2013); 5(215):215ra172; Glienke et al. *Front Pharmacol* (2015) 6:21; Kakarla & Gottschalk 52 *Cancer J* (2014) 20(2):151-5; Riddell et al. *Cancer J* (2014) 20(2):141-4; Pegram et al. *Cancer J* (2014) 20(2):127-33; Cheadle et al. *Immunol Rev* (2014) 257(1):91-106; Barrett et al. *Annu Rev Med* (2014) 65:333-47; Sadelain et al. *Cancer Discov* (2013) 3(4):388-98; Cartellieri et al., *J Biomed Biotechnol* (2010) 956304; the disclosures of which are incorporated herein by reference in their entirety.

As used herein, the term "immune cells" generally includes white blood cells (leukocytes) which are derived from hematopoietic stem cells (HSC) produced in the bone marrow "Immune cells" includes, e.g., lymphocytes (T cells, B cells, natural killer (NK) cells) and myeloid-derived cells (neutrophil, eosinophil, basophil, monocyte, macrophage, dendritic cells).

"T cell" includes all types of immune cells expressing CD3 including T-helper cells ($CD4^+$ cells), cytotoxic T-cells ($CD8^+$ cells), T-regulatory cells (Treg) and gamma-delta T cells.

A "cytotoxic cell" includes $CD8^+$ T cells, natural-killer (NK) cells, and neutrophils, which cells are capable of mediating cytotoxicity responses.

As used herein, the term "stem cell" generally includes pluripotent or multipotent stem cells. "Stem cells" includes, e.g., embryonic stem cells (ES); mesenchymal stem cells (MSC); induced-pluripotent stem cells (iPS); and committed progenitor cells (hematopoietic stem cells (HSC); bone marrow derived cells, neural progenitor cells, etc.).

As used herein, the terms "treatment," "treating," "treat" and the like, refer to obtaining a desired pharmacologic and/or physiologic effect. The effect can be prophylactic in terms of completely or partially preventing a disease or symptom thereof and/or can be therapeutic in terms of a partial or complete cure for a disease and/or adverse effect attributable to the disease. "Treatment," as used herein, covers any treatment of a disease in a mammal, particularly in a human, and includes: (a) preventing the disease from occurring in a subject which can be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (rats, mice), non-human primates, humans, canines, felines, ungulates (e.g., equines, bovines, ovines, porcines, caprines), lagomorphs, etc. In some cases, the individual is a human. In some cases, the individual is a non-human primate. In some cases, the individual is a rodent, e.g., a rat or a mouse. In some cases, the individual is a lagomorph, e.g., a rabbit.

A "therapeutically effective amount" or "efficacious amount" refers to the amount of an agent, or combined amounts of two agents, that, when administered to a mammal or other subject for treating a disease, is sufficient to effect such treatment for the disease. The "therapeutically effective amount" will vary depending on the agent(s), the disease and its severity and the age, weight, etc., of the subject to be treated.

As used herein, the term "heteromeric" refers to a polypeptide or protein that contains more than one kind of subunit. Such heteromeric polypeptides may, in some instances, be referred to as "a heteromer". Heteromeric polypeptides may contain two or more different polypeptides, wherein different polypeptides are defined at least as two polypeptides that are not identical, however, such different polypeptides may or may not include one or more portions of similar and/or identical amino acid sequence. In some instances, the two or more polypeptides of a heteromer share no identical amino acid sequence or share no identical domains. A heteromer may, in some instances, consist of two different polypeptides or two different types of polypeptides and may be referred to as a heterodimer. In some instances, a heteromer may consist of three different polypeptides or three different types of polypeptides and may be referred to as a heterotrimer. In some instances, a heteromer may consist of two or more different polypeptides or two or more different types of polypeptides, including but not limited to, e.g., three or more different polypeptides, four or more different polypeptides, five or more different polypeptides, six or more different polypeptides, seven or more different polypeptides, eight or more different polypeptides, etc.

The term "synthetic" as used herein generally refers to an artificially derived polypeptide or polypeptide encoding nucleic acid that is not naturally occurring. Such synthetic polypeptides and/or nucleic acids may be assembled de novo from basic subunits including, e.g., single amino acids, single nucleotides, etc., or may be derived from pre-existing polypeptides or polynucleotides, whether naturally or artificially derived, e.g., as through recombinant methods.

The term "recombinant", as used herein describes a nucleic acid molecule, e.g., a polynucleotide of genomic, cDNA, viral, semisynthetic, and/or synthetic origin, which, by virtue of its origin or manipulation, is not associated with all or a portion of the polynucleotide sequences with which it is associated in nature. The term recombinant as used with respect to a protein or polypeptide means a polypeptide produced by expression from a recombinant polynucleotide. The term recombinant as used with respect to a host cell or a virus means a host cell or virus into which a recombinant polynucleotide has been introduced. Recombinant is also used herein to refer to, with reference to material (e.g., a cell, a nucleic acid, a protein, or a vector) that the material has been modified by the introduction of a heterologous material (e.g., a cell, a nucleic acid, a protein, or a vector).

A "biological sample" encompasses a variety of sample types obtained from an individual or a population of individuals and can be used in a diagnostic, monitoring or screening assay. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by mixing or pooling of individual samples, treatment with reagents, solubilization, or enrichment for certain components, such as cells, polynucleotides, polypeptides, etc. The term "biological sample" encompasses a clinical sample, and also includes cells in culture, cell supernatants, cell lysates, serum, plasma, biological fluid, and tissue samples. The term "biological sample" includes urine, saliva, cerebrospinal fluid, interstitial fluid, ocular fluid, synovial fluid, blood fractions such as plasma and serum, and the like. The term "biological sample" also includes solid tissue samples, tissue culture samples, and cellular samples.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a dimerizing agent" includes a plurality of such dimerizing agents and reference to "the antigen-binding domain" includes reference to one or more antigen-binding domains and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Detailed Description

The present disclosure provides conditionally active, heterodimeric polypeptides. The conditionally active, heterodimeric polypeptides are active in the presence of a dimerizing agent that induces dimerization of the polypeptides of the heterodimer. A conditionally active, heterodimeric polypeptide of the present disclosure is useful in a variety of research and treatment methods, which are also provided.

Conditionally Active Heterodimeric Polypeptides

The present disclosure provides a heterodimeric, conditionally active polypeptide comprising: a) a first chimeric polypeptide comprising a first member of a dimerization pair and a first heterologous polypeptide; and b) a second chimeric polypeptide comprising a second member of a dimerization pair and a second heterologous polypeptide. In some cases, the first member of the dimerization pair comprises a ligand-binding domain (LBD) of a nuclear hormone receptor, and the second member of the dimerization pair comprises a co-regulator of the nuclear hormone receptor. In other cases, the first member of the dimerization pair is a co-regulator of a nuclear hormone receptor, and the second member of the dimerization pair comprises an LBD of the nuclear hormone receptor. The first chimeric polypeptide and the second chimeric polypeptide are dimerized in the presence of a dimerization agent that induces binding of the LBD to the co-regulator.

In some instances, the function of a conditionally active heterodimeric polypeptide of the present disclosure does not utilize a DNA-binding function or a transcription activating function of the nuclear hormone receptor from which the LBD is derived. Put another way, the function of the conditionally active heterodimeric polypeptide of the present disclosure may be independent of any DNA-binding function of the nuclear hormone receptor from which the LBD is derived. In some instances, activation of a conditionally active heterodimeric polypeptide of the present disclosure does not result in a transcription activating function attributable to a domain (e.g., a DNA-binding domain) of the nuclear hormone receptor from which a LBD of the conditionally active heterodimeric polypeptide is derived. In some instances, a conditionally active heterodimeric polypeptide of the present disclosure does not contain a DNA-binding domain of a nuclear hormone receptor, including e.g., the DNA-binding domain of the nuclear hormone receptor from which a LBD of a conditionally active heterodimeric polypeptide is derived.

A conditionally active heterodimeric polypeptide of the present disclosure can, in some instances, be activating. A conditionally active heterodimeric polypeptide of the present disclosure can, in some instances, have repressor activity. For example, where a conditionally active heterodimeric polypeptide of the present disclosure is present in the membrane of a cell, and the cell is contacted with a dimerizing agent that induces binding of the LBD to the co-regulator, in some cases, the conditionally active heterodimeric polypeptide activates the cell. For example, where a conditionally active heterodimeric polypeptide of the present disclosure is present in the membrane of a cell, and the cell is contacted with a dimerizing agent that induces binding of the LBD to the co-regulator, in some cases, the conditionally active heterodimeric polypeptide represses an activity in or by the cell. In some cases, activation of a conditionally active heterodimeric polypeptide of the present disclosure depends on the presence of a dimerization agent. In some cases, activation of a conditionally active heterodimeric polypeptide of the present disclosure depends on the presence of a dimerization agent and a second agent (e.g., an antigen). Depending on the nature of the conditionally active heterodimeric polypeptide and/or depending on the nature of the dimerization agent, activation of a conditionally active heterodimeric polypeptide of the present disclosure can result in activation of an activity of a cell (where the conditionally active heterodimeric polypeptide is present in the cell), or repression of an activity of a cell (where the conditionally active heterodimeric polypeptide is present in the cell). Depending on the nature of the conditionally active heterodimeric polypeptide and/or depending on the nature of the dimerization agent, activation of a conditionally active heterodimeric polypeptide of the present disclosure can result in activation of an activity of a heterologous polypeptide present in the conditionally active heterodimeric polypeptide, or can result in inhibition of an activity of a heterologous polypeptide present in the conditionally active heterodimeric polypeptide.

By "conditionally active" is meant that the activity attributable to the relevant heterodimeric polypeptide is dependent upon a condition, such as e.g., dimerization of the heterodimeric parts of the polypeptide. For instance, the activity of a heterodimeric polypeptide of the present disclosure may be conditionally dependent upon the presence of a dimerizing agent. In such instances, in the presence of the dimerizing agent, the heterodimeric polypeptide is "activatable", i.e., may be activated (e.g., through binding of the second member of a specific binding pair of the polypeptide, such as an antigen). Conditionally activatable polypeptides will generally not be activatable in the absence of dimerizing agent, i.e., the relevant polypeptide cannot be activated in the absence of the dimerizing agent regardless of whether some additional condition for function is met, e.g., the second member of a specific binding pair of the polypeptide (such as an antigen) is present and/or bound.

The activities attributable to the relevant polypeptides that may be conditionally dependent, e.g., on the presence of the relevant dimerizing agent, may vary and will generally include any activity including both activating activities and repressive activities as noted above and described in greater detail below. As an example, a conditionally active on-switch chimeric antigen receptor (CAR), as described in more detail below, may be activatable in the presence of the relevant dimerization agent such that, in the presence of both the dimerization agent and the relevant member of the specific binding pair to which the polypeptide binds, signal transduction resulting from the on-switch CAR may activate a cell (e.g., an immune cell) in which the on-switch CAR resides. In the contrary case, in the absence of the relevant dimerization agent, signal transduction which would lead to activation of a cell expressing the on-switch CAR does not occur regardless of the presence of the relevant member of the specific binding pair to which the on-switch CAR binds. As another example, the repression attributable to a conditionally active off-switch CAR, as described in more detail below, may be activatable in the presence of the relevant dimerization agent such that, in the presence of both the dimerization agent and the relevant member of the specific binding pair to which the polypeptide binds, the off-switch CAR may repress activation of a cell (e.g., an immune cell) in which the off-switch CAR resides. In the contrary case, in the absence of the relevant dimerization agent, activation of the off-switch CAR which would lead to repression of that activation of a cell expressing the off-switch CAR does not occur regardless of the presence of the relevant member of the specific binding pair to which the off-switch CAR binds.

Interacting Polypeptides

The first heterologous polypeptide and the second heterologous polypeptide of the subject conditionally active heterodimeric polypeptides can be any polypeptides that exhibit an activity when brought into proximity to one another, e.g., when the first chimeric polypeptide and the second chimeric polypeptide are dimerized by the dimerization agent that induces binding of the LBD to the co-regulator. The first and the second heterologous polypeptides do not exhibit that activity individually, e.g., when not in proximity to one another. In other words, activity of the first heterologous polypeptide and the second heterologous polypeptide is dependent upon assembly of the two polypeptides. For example, in some cases, the first heterologous polypeptide is a receptor and the second heterologous polypeptide is a co-receptor. In some cases, the first heterologous polypeptide is a T-cell receptor (TCR) alpha chain; and the second heterologous polypeptide is a TCR beta chain. In some cases, the first heterologous polypeptide is a first polypeptide of a chimeric antigen receptor (CAR) heterodimer; and the second heterologous polypeptide is a second polypeptide of the CAR heterodimer. In some cases, the first heterologous polypeptide and the second heterologous polypeptide are caspases. In some cases, the first heterologous polypeptide is a first subunit of a polypeptide; and the second heterologous polypeptide is a second subunit of the polypeptide. In some cases, the first heterologous polypeptide is an enzyme; and the second heterologous polypeptide is a polypeptide substrate of the enzyme. In some cases, the first heterologous polypeptide is a scaffold polypeptide (e.g., LAT; SLP76; and the like); and the second heterologous polypeptide is a polypeptide that conditionally binds to the scaffold polypeptide. In some cases, the first heterologous polypeptide is a signal transducing adaptor protein (e.g., MyD88; Grb2; SHC1); and the second heterologous polypeptide is a polypeptide that conditionally binds the signal transducing adaptor protein. In some cases, the first and second heterologous polypeptides are dimerization-dependent cell-surface receptors (e.g., cytokine receptors, receptor tyrosine kinases (RTK), and the like) or a portion thereof. In some cases, the first and the second heterologous polypeptides are the same dimerization-dependent cell-surface receptor (e.g., the same cytokine receptor, the same RTK, etc.) or the same portions of a dimerization-dependent cell-surface receptor.

In some cases, the first heterologous polypeptide and the second heterologous polypeptide have the same amino acid sequence. In some cases, the first heterologous polypeptide and the second heterologous polypeptide have different amino acid sequences.

Split Products

In some cases, the first heterologous polypeptide and the second heterologous polypeptide are split products of a single parent polypeptide that exhibit an activity of the parent polypeptide when brought into proximity to one another, e.g., when the first chimeric polypeptide and the second chimeric polypeptide are dimerized by the dimerization agent that induces binding of the LBD to the co-regulator. For example, in some cases, the first heterologous polypeptide is an N-terminal portion of a parent polypeptide; and the second heterologous polypeptide is the C-terminal portion of the parent polypeptide. The N-terminal portion and the C-terminal portion of the parent polypeptide, when split such that they are not in proximity to one another, do not individual exhibit the activity of the parent polypeptide. For example, in some cases, the first heterologous polypeptide and the second heterologous polypeptide are split products of a kinase. As another example, in some cases, the first heterologous polypeptide and the second heterologous polypeptide are split products of a protease. As another example, in some cases, the first heterologous polypeptide and the second heterologous polypeptide are split products of a fluorescent protein; see, e.g., Ghosh et al. (2000) *J. Am. Chem. Soc.* 122:5658. As another example, in some cases, the first heterologous polypeptide and the second heterologous polypeptide are split products of ubiquitin; see, e.g., Johnsson and Varshaysky (1994) *Proc. Natl. Acad. Sci. USA* 91:10340. As another example, in some cases, the first heterologous polypeptide and the second heterologous polypeptide are split products of a lactamase polypeptide; see, e.g., Galarneau et al. (2002) *Nat. Biotechnol.* 20:619. As another example, in some cases, the first heterologous polypeptide and the second heterologous polypeptide are split products of luciferase; see, e.g., Luker et al. (2004) *Proc. Natl. Acad. Sci. USA* 101:12288; Remy and Michnick (2006) *Nat. Methods* 3:977; and Paulmurugan and Gambhir (2003) *Anal. Chem.* 75:1584. As another example, in some cases, the first heterologous polypeptide and the second heterologous polypeptide are split products of a caspase. As another example, in some cases, the first heterologous polypeptide and the second heterologous polypeptide are split products of a phosphatase. As another example, in some cases, the first heterologous polypeptide and the second heterologous polypeptide are split products of an endonuclease. As another example, in some cases, the first heterologous polypeptide and the second heterologous polypeptide are split products of an RNA-guided endonuclease. As another example, in some cases, the first heterologous polypeptide and the second heterologous polypeptide are split products of a Tobacco etch virus (TEV) protease; see, e.g., Gray et al. (2010) *Cell* 142:637. As another example, in some cases, the first heterologous polypeptide and the second heterologous polypeptide are split products of a tyrosine phosphatase; see, e.g., Camacho-Soto et al. (2014) *J. Am. Chem. Soc.* 136:17078. As another example, in some cases, the first heterologous polypeptide and the second heterologous polypeptide are split products of a Cas9 polypeptide; see, e.g., Zetche et al. (2015) *Nat. Biotechnol.* 33:139.

As noted above, in some cases, the first heterologous polypeptide and the second heterologous polypeptide are split products of a kinase. As a non-limiting example, a tyrosine kinase can be the parent polypeptide; and split product of the parent tyrosine kinase can be the first heterologous polypeptide and the second heterologous polypeptide. For example, a tyrosine kinase can be split between amino acids E393 and D394 of the amino acid sequence depicted in FIG. 20A, or a corresponding site in a different tyrosine kinase, such that the first heterologous polypeptide is an N-terminal portion of the tyrosine kinase ending with E393, and the second heterologous polypeptide is a C-terminal portion of the tyrosine kinase beginning with D394. As an example, the first heterologous polypeptide can comprise the amino acid sequence depicted in FIG. 20B; and the second heterologous polypeptide can comprise the amino acid sequence depicted in FIG. 20C. As another example, a tyrosine kinase can be split between amino acids E572 and D573 of the amino acid sequence depicted in FIG. 21, or a corresponding site in a different tyrosine kinase, such that the first heterologous polypeptide is an N-terminal portion of the tyrosine kinase ending with E572, and the second heterologous polypeptide is a C-terminal portion of the tyrosine kinase beginning with D573. See, e.g., Camacho-Soto et al. (2014) J. Am. Chem. Soc. 136:3995. Tyrosine kinases include, e.g., Lyn, Fak, Src, and PKA. Tyrosine kinases include, e.g., ABL1, ABL1 (T315I), ACVR1, AKT1, ALK, AURKA, AXL, BTK, CAMK2D, CDK1B, CDK2A, CDK4D1, CSK, CSNK1G3, EGFR, EPHA4, EPHB4, ERBB4, FGFR1, FGFR2, FGFR3, FGFR3 (K650E), FGFR4, FLT3 (D835Y), IGF1R, GSK3B, INSR, IRAK4, JAK1, JAK2, JAK3, KDR, KIT, LCK, LYN, MAP3K8, MAPK1, MAPK10, MAPK14, MAPKAPK2, MAPKAPK5, MET, MKNK1, MKNK2, PAK2, PDGFRa, PDPK1, PIM2, PKN1, PKN2, PLK1, PRKACA, PRKCA, PRKCQ, RET, ROCK2, RPS6 KB1, SRC, SYK, TYK2, WNK1, ZAP70, PIKSCD, PIK3CG, MTOR, PIK3C3, PIK3CA, PIK3CB and PIK4CB. Suitable tyrosine kinases include SYK, LCK, IRK (=INSR=Insulin receptor), IGF-1 receptor, MK2, ZAP-70, Aurora-2, PRAK, ROCK, CAK, cMET, IRAK1, IRAK2, BLK, BMX, BTK, FRK, FGR, FYN, HCK, ITK, LYN, TEC, TXK, YES, ABL, SRC, EGF-R (=ErbB-1), ErbB-2 (=NEU=HER 2), ErbB-3, ErbB-4, FAK, FGF1R (=FGR-1), FGF2R (=FGR-2), IKK-1 (=IKK-α=CHUK), IKK-2 (=IKKβ), MET (=c-Met), NIK, PGDF receptor α, PDGF receptor β, TIE1, TIE2 (=TEK), VEGFR 1 (=FLT-1), VEGFR 2 (=KDR), FLT-3, FLT-4, KIT, CSK, JAK1, JAK2, JAK3, TYK2, RIP, RIP-2, LOK, TAKI, RET, ALK, MLK3, COT, TRKA, PYK2, EPHB4, RON, GSK3, UL13, ORF47, ATM, CDK (including all subtypes), PKA, PKB (including all PKB subtypes) (=AKT-1, AKT-2, AKT-3), PKC (including all PKC subtypes), REDK, SAPK, PIM, PDK, PIM, ERK and BARK, and all subtypes of these kinases.

As noted above, in some cases, the first heterologous polypeptide and the second heterologous polypeptide are split products of a caspase. Chelur and Chalfie (2007) *Proc. Natl. Acad. Sci. USA* 104:2283. In some cases, the caspase is an apoptotic caspase.

As noted above, in some cases, the first heterologous polypeptide and the second heterologous polypeptide are split products of a Cas9 polypeptide. A Cas9 polypeptide can comprise an amino acid sequence having at least 50%, at least 60%, at least 70%, at least 75%, at least 80%, at least 85%, at least 90%, at least 95%, at least 98%, at least 99%, or 100%, amino acid sequence identity to the amino acid sequence depicted in FIG. 28. In some cases, the Cas9 is a catalytically inactive Cas9 ("dCas9"); e.g., where the dCas9 comprises a D10A and an H840A substitution relative to the amino acid sequence depicted in FIG. 28, or corresponding amino acids of another Cas9 polypeptide.

Specific Binding Pairs and Extracellular Recognition Domains

The present disclosure provides conditionally active, heterodimeric polypeptides. The conditionally active, heterodimeric polypeptides, when expressed on the plasma membrane of a cell, are active in the presence of: 1) an antigen or other moiety that interacts with the extracellular domain; and 2) a dimerizing agent that induces dimerization of the polypeptides of the heterodimer.

In some cases, a conditionally active heterodimeric polypeptide of the present disclosure comprises: a) a first polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second polypeptide comprising: i) a transmembrane domain; ii) a second modulatory domain; iii) a second member of the dimerization pair; and iv) an intracellular signaling domain. In some cases, the first member of the dimerization pair comprises a ligand-binding domain (LBD) of a nuclear hormone receptor, and the second member of the dimerization pair comprises a co-regulator of the nuclear hormone receptor. In some cases, the first member of the dimerization pair comprises a co-regulator of a nuclear hormone receptor, and the second member of the dimerization pair comprises an LBD of the nuclear hormone receptor.

Thus, in some cases, a conditionally active heterodimeric polypeptide of the present disclosure comprises: a) a first polypeptide comprising: i) a first member of a specific binding pair; ii) a first modulatory domain; iii) a first member of a dimerization pair, wherein the first member of the dimerization pair comprises an LBD of a nuclear hormone receptor; and iv) a transmembrane domain interposed between the first member of a specific binding pair and the first modulatory domain; and b) a second polypeptide comprising: i) a transmembrane domain; ii) a second modulatory domain; iii) a second member of the dimerization pair, wherein the second member of the dimerization pair comprises a co-regulator of the nuclear hormone receptor; and iv) an intracellular signaling domain. In other cases, a conditionally active heterodimeric polypeptide of the present disclosure comprises: a) a first polypeptide comprising: i) a first member of a specific binding pair; ii) a first modulatory domain; iii) a first member of a dimerization pair, wherein the first member of the dimerization pair comprises a co-regulator of a nuclear hormone receptor; and iv) a transmembrane domain interposed between the first member of a specific binding pair and the first modulatory domain; and b) a second polypeptide comprising: i) a transmembrane domain; ii) a second modulatory domain; iii) a second member of the dimerization pair, wherein the second member of the dimerization pair comprises an LBD of the nuclear hormone receptor; and iv) an intracellular signaling domain.

In some cases, a conditionally active heterodimeric polypeptide of the present disclosure comprises: a) a first polypeptide comprising: i) a first member of a specific binding pair; ii) a modulatory domain; iii) a first member of a dimerization pair; iv) a transmembrane domain interposed between the first member of a specific binding pair and the modulatory domain; and b) a second polypeptide comprising: i) a second member of the dimerization pair; and ii) an intracellular signaling domain. In some cases, the first member of the dimerization pair comprises an LBD of a nuclear hormone receptor, and the second member of the dimerization pair is a co-regulator of the nuclear hormone receptor. In some cases, the first member of the dimerization pair is a co-regulator of a nuclear hormone receptor, and the second member of the dimerization pair comprises an LBD of the nuclear hormone receptor.

In some cases, a conditionally active heterodimeric polypeptide of the present disclosure is a conditionally active on-switch chimeric antigen receptor (CAR). In some cases, a conditionally active heterodimeric polypeptide of the present disclosure is a conditionally active off-switch CAR. In some cases, a conditionally active heterodimeric polypeptide of the present disclosure is a conditionally active T-cell receptor (TCR).

The present disclosure provides a heterodimeric, conditionally repressible synthetic immune cell receptor (ICR) comprising: a synthetic stimulatory ICR comprising a first member of a dimerization pair linked to the synthetic stimulatory ICR; and a synthetic ICR repressor comprising a second member of the dimerization pair linked to an intracellular inhibitory domain, wherein the first member of the dimerization pair comprises an LBD of a nuclear hormone receptor, and the second member of the dimerization pair comprises a co-activator of the nuclear hormone receptor, or wherein the first member of the dimerization pair is a co-activator of a nuclear hormone receptor, and the second member of the dimerization pair comprises an LBD of the nuclear hormone receptor. The synthetic stimulatory ICR and the synthetic ICR repressor are dimerized in the presence of a ligand (dimerization agent) that induces binding of the LBD to the co-regulator.

The present disclosure provides a heterodimeric, conditionally repressible synthetic chimeric antigen receptor (CAR) comprising: a) a synthetic stimulatory CAR comprising: i) a extracellular recognition domain; ii) a transmembrane domain linked to the extracellular recognition domain; iii) a first member of a dimerization pair linked to the transmembrane domain; and iv) an intracellular stimulation domain; and b) a synthetic CAR repressor comprising: i) a second member of the dimerization pair; and ii) an intracellular inhibitory domain linked to the second member of the dimerization pair. The first member of the dimerization pair comprises an LBD of a nuclear hormone receptor, and the second member of the dimerization pair comprises a co-activator of the nuclear hormone receptor; or the first member of the dimerization pair is a co-activator of a nuclear hormone receptor, and the second member of the dimerization pair comprises an LBD of the nuclear hormone receptor. The synthetic stimulatory CAR and the synthetic CAR repressor are dimerized in the presence of a dimerization agent that induces binding of the LBD to the co-regulator.

The present disclosure provides a heterodimeric, conditionally repressible synthetic T cell receptor (TCR) comprising: a) a synthetic stimulatory TCR comprising: i) a transmembrane domain; ii) a first member of a dimerization pair linked to the transmembrane domain; iii) an engineered TCR polypeptide comprising at least one TCR alpha or beta chain, wherein the at least one TCR alpha or beta chain is linked to the transmembrane domain or the first member of a dimerization pair; and b) a synthetic TCR repressor comprising: i) a second member of the dimerization pair; and ii) an intracellular inhibitory domain linked to the second member of the dimerization pair. The first member of the dimerization pair comprises an LBD of a nuclear hormone receptor, and the second member of the dimerization pair comprises a co-activator of the nuclear hormone receptor; or the first member of the dimerization pair is a co-activator of a nuclear hormone receptor, and the second member of the dimerization pair comprises an LBD of the nuclear hormone receptor. The synthetic stimulatory TCR and the synthetic TCR repressor are dimerized in the presence of a dimerization agent that induces binding of the LBD to the co-regulator.

The present disclosure provides a heterodimeric, conditionally active chimeric antigen receptor (CAR) comprising: I) a) a first polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second polypeptide comprising: i) a transmembrane domain; ii) a second modulatory domain; iii) a second member of the dimerization pair; and iv) an intracellular signaling domain; or II) a) a first polypeptide comprising: i) a first member of a specific binding pair; ii) a modulatory domain; iii) a first member of a dimerization pair; iv) a transmembrane domain interposed between the first member of a specific binding pair and the modulatory domain; and b) a second polypeptide comprising: i) a second member of the dimerization pair; and ii) an intracellular signaling domain. The first member of the dimerization pair comprises an LBD of a nuclear hormone receptor, and the second member of the dimerization pair comprises a co-activator of the nuclear hormone receptor; or the first member of the dimerization pair is a co-activator of a nuclear hormone receptor, and the second member of the dimerization pair comprises an LBD of the nuclear hormone receptor. The first polypeptide and the second polypeptide are dimerized in the presence of a dimerization agent that induces binding of the LBD to the co-regulator.

Conditionally Active On-Switch CAR

In some cases, a conditionally active heterodimeric polypeptide of the present disclosure is a conditionally active on-switch chimeric antigen receptor (CAR).

Member of a Specific Binding Pair

As noted above, a conditionally active heterodimeric polypeptide of the present disclosure comprises a first polypeptide comprising a first member of a specific binding pair. The second member of the specific binding pair can be present on the surface of a cell. The second member of the specific binding pair can be immobilized on an insoluble support, expressed on the surface of a cell (e.g., a target cell, a non-target cell, etc.), or the like. The second member of the specific binding pair can be soluble. The second member of the specific binding pair can be present in an extracellular environment (e.g., extracellular matrix). The second member of the specific binding pair can be present in an artificial matrix. The second member of the specific binding pair can be present in an acellular environment.

Suitable first members of a specific binding pairs include, but are not limited to, antibody-based recognition scaffolds; antibodies (i.e., an antibody-based recognition scaffold, including antigen-binding antibody fragments); non-antibody-based recognition scaffolds; antigens (e.g., endogenous antigens; exogenous antigens; etc.); a ligand for a receptor; a receptor; a target of a non-antibody-based recognition scaffold; an Fc receptor (e.g., FcγRIIIa; FcγRIIIb; etc.); an extracellular matrix component; and the like.

Specific binding pairs include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

Antigen-Binding Domain

An antigen-binding domain suitable for use in a conditionally active heterodimeric polypeptide of the present disclosure can be any antigen-binding polypeptide, a wide variety of which are known in the art. In some instances, the antigen-binding domain is a single chain Fv (scFv). Other antibody based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing VαVβ) are also suitable for use.

An antigen-binding domain suitable for use in a conditionally active heterodimeric polypeptide of the present disclosure can have a variety of antigen-binding specificities. In some cases, the antigen-binding domain is specific for an epitope present in an antigen that is expressed by (synthesized by) a cancer cell, i.e., a cancer cell associated antigen. The cancer cell associated antigen can be an antigen associated with, e.g., a breast cancer cell, a B cell lymphoma, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma cell, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer cell associated antigen may also be expressed by a non-cancerous cell.

Non-limiting examples of antigens to which an antigen-binding domain of a conditionally active heterodimeric polypeptide of the present disclosure can bind include, e.g., CD19, CD20, CD38, CD30, Her2/neu/ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like.

In some instances, an antigen-binding domain of a conditionally active heterodimeric polypeptide of the instant disclosure may target a cancer-associated antigen. In some instances, an antigen-binding domain of the instant disclosure may include an antibody or portion thereof specific for a cancer associated antigen. Non-limiting examples of cancer associated antigens include but are not limited to e.g., CD19, CD20, CD38, CD30, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Cancer-associated antigens also include, e.g., 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CEA, CNTO888, CTLA-4, DR5, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin α5β1, integrin αvβ3, MORAb-009, MS4A1, MUC1, mucin CanAg, N-glycolylneuraminic acid, NPC-1C, PDGF-R α, PDL192, phosphatidylserine, prostatic carcinoma cells, RANKL, RON, ROR1, SCH 900105, SDC1, SLAMF7, TAG-72, tenascin C, TGF beta 2, TGF-β, TRAIL-R1, TRAIL-R2, tumor antigen CTAA16.88, VEGF-A, VEGFR-1, VEGFR2, and vimentin.

In some instances, an antigen-binding domain may specifically bind a target comprising a fragment of a protein (e.g., a peptide) in conjunction with a major histocompatibility complex (MHC) molecule. As MHC molecules present peptide fragments of both intracellularly expressed and extracellularly expressed proteins, specific binding members directed to MHC-peptide complexes allows for the targeting of intracellular antigens as well as extracellularly expressed antigens.

Intracellularly expressed target proteins (e.g., cytoplasmically expressed (i.e., cytoplasmic proteins), nuclearly expressed (i.e., nuclear proteins), etc.) may be referred to as intracellular antigens (e.g., cytoplasmic antigens, nuclear antigens, etc.). Accordingly, antigen-binding domains of the subject disclosure may, in some instances, be specific for intracellular antigen fragments complexed with MHC, e.g., a peptide-MHC complex, also, in some instances, described as a human leukocyte antigen (HLA)-peptide complex.

Exemplary protein targets to which an antigen-binding domain targeting a peptide-MHC complex may be directed as well as exemplary peptides in the context of MHC for each protein target are provided in Table 2 below.

TABLE 2 anti-peptide-MHC targets

| Target | Exemplary Peptides | HLA | References |
|---|---|---|---|
| WT1 | RMFPNAPYL (SEQ ID NO: 470) | HLA-A2 | Leukemia. (2015) 29(11):2238-47 |
| KRAS and KRAS mutants (e.g., G12V & G12C) | KLVVVGAGGV (SEQ ID NO: 471); KLVVVGAVGV (SEQ ID NO: 742); KLVVVGACGV (SEQ ID NO: 473); KLVVVGADGV (SEQ ID NO: 744); VVGAVGVGK (SEQ ID NO: 745); VVGACGVGK (SEQ ID NO: 476); VVGAGGVGK (SEQ ID NO: 477) | HLA-A2; HLA-A3 | Proc Natl Acad Sci U S A. (2015) 112(32) |
| EGFP and EGFP mutants (e.g., L858R) | KITDFGLAK (SEQ ID NO: 478); KITDFGRAK (SEQ ID NO: 479); | HLA-A3 | Proc Natl Acad Sci U S A. (2015) 112(32) |
| PR1 | VLQELNVTV (SEQ ID NO: 480) | HLA-A2 | Cytotherapy. (2016) 18(8):985-94 |
| MAGE-A1 | EADPTGHSY (SEQ ID NO: 481) | HLA-A1 | Blood. (2011) 117(16):4262-4272 |
| P53 | LLGRNSFEV (SEQ ID NO: 482); STTPPPGTRV (SEQ ID NO: 483) | HLA-A2 | Gene Ther. (2001) 8(21):1601-8 |
| MART-1 | ELAGIGILTV (SEQ ID NO: 484) | HLA-A2 | Biomark Med. (2010) 4(4):496-7 |
| gp100 | IMDQVPFSV (SEQ ID NO: 485) | HLA-A2 | Biomark Med. (2010) 4(4):496-7 |
| CMV pp65 | NLVPMVATV (SEQ ID NO: 486) | HLA-A2 | Biomark Med. (2010) 4(4):496-7 |
| HIV Vpr | AIIRILQQL (SEQ ID NO: 487) | HLA-A2 | Biomark Med. (2010) 4(4):496-7 |
| HA-1H | VLHDDLLEA (SEQ ID NO: 488); VLRDDLLEA (SEQ ID NO: 489) | HLA-A2 | Biomark Med. (2010) 4(4):496-7 |
| NY-ESO-1 | SLLMWITQV (SEQ ID NO: 490) | HLA-A2 | Gene Ther. (2014) 21(6):575-84 |
| EBNA3C | LLDFVRFMGV (SEQ ID NO: 491) | HLA-A2 | Proc Natl Acad Sci U S A. (2009) 106(14):5784-8 |
| AFP | FMNKFIYEI (SEQ ID NO: 492) | HLA-A2 | Cancer Gene Ther. (2012) 19(2):84-100 |
| Her2 | KIFGSLAFL (SEQ ID NO: 493) | HLA-A2 | Clin Cancer Res. (2016) pii: clincanres 1203.2016 |
| hCG-beta | GVLPALPQV (SEQ ID NO: 494) | HLA-A2 | J Natl Cancer Inst. (2013) 105(3):202-18 |
| HBV Env183-91 | FLLTRILTI (SEQ ID NO: 495) | HLA-A2 | J Immunol. (2006) 177(6):4187-95 |

In some instances, the antigen-binding domain of a conditionally active heterodimeric polypeptide of the instant disclosure is or includes a portion of an antibody (e.g., a scFv) that specifically binds a peptide-MHC having an intracellular cancer antigen peptide of Table 2.

In some instances, the antigen-binding domain of a conditionally active heterodimeric polypeptide of the instant disclosure is or includes a portion of an antibody (e.g., a scFv) that specifically binds a peptide-MHC described in Dhanik et al. *BMC Bioinformatics* (2016) 17:286, the disclosure of which is incorporated herein by reference in its entirety, including but not limited to e.g., a NLRP4 peptide (e.g., HLSPIDCEV (SEQ ID NO:496))-MHC complex, a UMODL1 peptide (e.g., LTSMWSPAV (SEQ ID NO:497))-MHC complex, a NLRP4 peptide (e.g., HLDHPHPAV (SEQ ID NO:498))-MHC complex, a MAGEC2 peptide (e.g., SLSVMSSNV (SEQ ID NO:499))-MHC complex, a NLRP4 peptide (e.g., MMAWSDNKI (SEQ ID NO:500))-MHC complex, a COX7B2 peptide (e.g., TQIGIEWNL (SEQ ID NO:501))-MHC complex, a NLRP4 peptide (e.g., CLFEMQDPA (SEQ ID NO:502))-MHC complex, a UMODL1 peptide (e.g., YLSHPSCNV (SEQ ID NO:503))-MHC complex, a COX7B2 peptide (e.g., GIEWNLSPV (SEQ ID NO:504))-MHC complex, a MAGEA11 peptide (e.g., GLGCSPASI (SEQ ID NO:505))-MHC complex, a RPE65 peptide (e.g., RQAFEFPQI (SEQ ID NO:506))-MHC complex, a RPE65 peptide (e.g., RQAFEFPQI (SEQ ID NO:507))-MHC complex, a NLRP4 peptide (e.g., GMWTDTFEF (SEQ ID NO:508))-MHC complex, a TRIM51 peptide (e.g., YLNWQDTAV (SEQ ID NO:509))-MHC complex, a MAGEA11 peptide (e.g., VLWGPITQI (SEQ ID NO:510))-MHC complex, a NLRP4 peptide (e.g., TLDHTGVVV (SEQ ID NO:511))-MHC complex, a RPE65 peptide (e.g., TMGVWLHIA (SEQ ID NO:512))-MHC complex, a RPE65 peptide (e.g., TMGVWLHIA (SEQ ID NO:513))-MHC complex, a MAGEC2 peptide (e.g., KVWVQGHYL (SEQ ID NO:514))-MHC complex, a UMODL1 peptide (e.g., KINCNNFRL (SEQ ID NO:515))-MHC complex, etc.

Ligand

In some cases, a member of a specific binding pair suitable for use in a subject conditionally active heterodimeric polypeptide is a ligand for a receptor. Ligands include, but are not limited to, cytokines (e.g., IL-13, etc.); growth factors (e.g., heregulin; vascular endothelial growth factor (VEGF); and the like); an integrin-binding peptide (e.g., a peptide comprising the sequence Arg-Gly-Asp); and the like.

Where the member of a specific binding pair in a subject conditionally active heterodimeric polypeptide is a ligand, the conditionally active heterodimeric polypeptide can be activated in the presence of both a dimerizer agent and a second member of the specific binding pair, where the second member of the specific binding pair is a receptor for the ligand. For example, where the ligand is VEGF, the second member of the specific binding pair can be a VEGF receptor, including a soluble VEGF receptor. As another example, where the ligand is heregulin, the second member of the specific binding pair can be Her2.

Receptors

As noted above, in some cases, the member of a specific binding pair that is included in a subject conditionally active heterodimeric polypeptide is a receptor, e.g., a receptor for a ligand, a co-receptor, etc. The receptor can be a ligand-binding fragment of a receptor. Suitable receptors include, but are not limited to, a growth factor receptor (e.g., a VEGF receptor); a killer cell lectin-like receptor subfamily K, member 1 (NKG2D) polypeptide (receptor for MICA, MICB, and ULB6); a cytokine receptor (e.g., an IL-13 receptor; an IL-2 receptor; etc.); Her2; CD27; a natural cytotoxicity receptor (NCR) (e.g., NKP30 (NCR3/CD337) polypeptide (receptor for HLA-B—associated transcript 3 (BAT3) and B7-H6); etc.); etc.

Antibody-Based Recognition Scaffolds

In some cases, the first member of the specific binding pair is an antibody. The antibody can be any antigen-binding antibody-based polypeptide, a wide variety of which are known in the art. In some instances, the antigen-binding domain is a single chain Fv (scFv). Other antibody based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing VαVβ) are also suitable for use.

Where the member of a specific binding pair in a conditionally active heterodimeric polypeptide of the present disclosure is an antibody-based recognition scaffold, the conditionally active heterodimeric polypeptide can be activated in the presence of a second member of the specific binding pair, where the second member of the specific binding pair is an antigen that binds to the antibody-based recognition scaffold.

An antibody suitable for inclusion in a conditionally active heterodimeric polypeptide of the present disclosure can have a variety of antigen-binding specificities.

In some cases, the antigen-binding domain is specific for an epitope present in an antigen that is expressed by (synthesized by) a cancer cell, i.e., a cancer cell associated antigen. The cancer cell associated antigen can be an antigen associated with, e.g., a breast cancer cell, a B cell lymphoma, a pancreatic cancer, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma cell, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer cell associated antigen may also be expressed by a non-cancerous cell.

In some cases, the antigen-binding domain is specific for an epitope present in a tissue-specific antigen, including e.g., those antigens described herein. In some cases, the antigen-binding domain is specific for an epitope present in a disease-associated antigen, including e.g., those antigens described herein.

Non-limiting examples of antigens to which an antigen-binding domain of a subject conditionally active heterodimeric polypeptide can bind include, e.g., CD19, CD20, CD38, CD30, Her2/neu/ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like.

Non-limiting examples of antigens to which an antigen-binding domain of a subject conditionally active heterodimeric polypeptide can bind include, e.g., Cadherins (CDH1-20), Integrins (alpha and beta isoforms), Ephrins, NCAMs, connexins, CD44, syndecan, CD47, DGalpha/beta, SV2, protocadherin, Fas, Dectin-1, CD7, CD40, Neuregulin, KIR, BTLA, Tim-2, Lag-3, CD19, CTLA4, CD28, TIGIT, and ICOS.

In some cases, the antibody is specific for a cytokine. In some cases, the antibody is specific for a cytokine receptor. In some cases, the antibody is specific for a growth factor. In some cases, the antibody is specific for a growth factor receptor. In some cases, the antibody is specific for a cell-surface receptor.

In some cases, the antibody is specific for a cell surface target, where non-limiting examples of cell surface targets include CD19, CD30, Her2, CD22, ENPP3, EGFR, CD20, CD52, CD 11a, and alpha-integrin.

In some cases, the antigen (second member of the specific binding pair) bound by the antibody-based scaffold is soluble. In some cases, the antigen is membrane-bound, e.g., in some cases, the antigen is present on the surface of a cell. In some cases, the antigen is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the antigen is present in an extracellular matrix (ECM) (e.g., the antigen is an ECM component). In some cases, the antigen is present in an artificial matrix. In some cases, the antigen is present in an acellular environment.

Non-Antibody-Based Recognition Scaffolds

In some cases, the first member of the specific binding pair is a non-antibody-based recognition scaffold. Where the member of a specific binding pair in a conditionally active heterodimeric polypeptide of the present disclosure is a non-antibody-based recognition scaffold, the conditionally active heterodimeric polypeptide can be activated in the presence of a second member of the specific binding pair, where the second member of the specific binding pair is a target that binds to the non-antibody-based recognition scaffold.

Non-antibody-based recognition scaffolds include, e.g., affibodies; engineered Kunitz domains; monobodies (adnectins); anticalins; designed ankyrin repeat domains (DARPins); a binding site of a cysteine-rich polypeptide (e.g., cysteine-rich knottin peptides); avimers; afflins; and the like. See, e.g., Gebauer and Skerra (2009) Curr. Opin. Chem. Biol. 13:245.

Non-antibody-based scaffolds (also referred to herein as "antibody mimic molecules") may be identified by selection or isolation of a target-binding variant from a library of binding molecules having artificially diversified binding sites. Diversified libraries can be generated using completely random approaches (e.g., error-prone polymerase chain reaction (PCR), exon shuffling, or directed evolution) or aided by art-recognized design strategies. For example, amino acid positions that are usually involved when the binding site interacts with its cognate target molecule can be randomized by insertion of degenerate codons, trinucleotides, random peptides, or entire loops at corresponding positions within the nucleic acid which encodes the binding site (see e.g., U.S. Pub. No. 20040132028). The location of the amino acid positions can be identified by investigation of the crystal structure of the binding site in protein entity with the target molecule. Candidate positions for randomization include loops, flat surfaces, helices, and binding cavities of the binding site. In certain embodiments, amino acids within the binding site that are likely candidates for diversification can be identified by their homology with the immunoglobulin fold. For example, residues within the CDR-like loops of fibronectin may be randomized to generate a library of fibronectin binding molecules (see, e.g., Koide et al., J. Mol. Biol., 284: 1141-1151 (1998)). Other portions of the binding site which may be randomized include flat surfaces. Following randomization, the diversified library may then be subjected to a selection or screening procedure to obtain binding molecules with the desired binding characteristics. For example, selection can be achieved by art-recognized methods such as phage display, yeast display, or ribosome display.

For example, in some cases, the non-antibody-based scaffold comprises a binding site from a fibronectin binding molecule. Fibronectin binding molecules (e.g., molecules comprising the Fibronectin type I, II, or III domains) display CDR-like loops which, in contrast to immunoglobulins, do not rely on intra-chain disulfide bonds. The FnIII loops comprise regions that may be subjected to random mutation and directed evolutionary schemes of iterative rounds of target binding, selection, and further mutation in order to develop useful therapeutic tools. Fibronectin-based "addressable" therapeutic binding molecules ("FATBIM") can be developed to specifically bind the target antigen or epitope. Methods for making fibronectin binding polypeptides are described, for example, in WO 01/64942 and in U.S. Pat. Nos. 6,673,901, 6,703,199, 7,078,490, and 7,119,171.

As another example, in some cases, the non-antibody-based scaffold comprises a binding site from an affibody. Affibodies are derived from the immunoglobulin binding domains of staphylococcal Protein A (SPA) (see e.g., Nord et al., Nat. Biotechnol., 15: 772-777 (1997)). An affibody is an antibody mimic that has unique binding sites that bind specific targets. Affibodies can be small (e.g., consisting of three alpha helices with 58 amino acids and having a molar mass of about 6 kDa), have an inert format (no Fc function), and have been successfully tested in humans as targeting moieties. Affibody binding sites can be synthesized by mutagenizing an SPA-related protein (e.g., Protein Z) derived from a domain of SPA (e.g., domain B) and selecting for mutant SPA-related polypeptides having binding affinity for a target antigen or epitope. Other methods for making affibody binding sites are described in U.S. Pat. Nos. 6,740,734 and 6,602,977 and in WO 00/63243.

As another example, in some cases, the non-antibody-based scaffold comprises a binding site from an anticalin. An anticalin is an antibody functional mimetic derived from a human lipocalin. Lipocalins are a family of naturally-occurring binding proteins that bind and transport small hydrophobic molecules such as steroids, bilins, retinoids, and lipids. The main structure of an anticalin is similar to wild type lipocalins. The central element of this protein architecture is a beta-barrel structure of eight antiparallel strands, which supports four loops at its open end. These loops form the natural binding site of the lipocalins and can be reshaped in vitro by extensive amino acid replacement, thus creating novel binding specificities. Anticalins possess high affinity and specificity for their ligands as well as fast binding kinetics, so that their functional properties are similar to those of antibodies. Anticalins are described in, e.g., U.S. Pat. No. 7,723,476.

As another example, in some cases, the non-antibody-based scaffold comprises a binding site from a cysteine-rich polypeptide. Cysteine-rich domains in some cases do not form an alpha-helix, a beta-sheet, or a beta-barrel structure. In some cases, the disulfide bonds promote folding of the domain into a three-dimensional structure. In some cases, cysteine-rich domains have at least two disulfide bonds, e.g., at least three disulfide bonds. An exemplary cysteine-rich polypeptide is an A domain protein. A-domains (sometimes called "complement-type repeats") contain about 30-50 or 30-65 amino acids. In some cases, the domains comprise about 35-45 amino acids and in some cases about 40 amino acids. Within the 30-50 amino acids, there are about 6 cysteine residues. Of the six cysteines, disulfide bonds typically are found between the following cysteines: C1 and C3, C2 and C5, C4 and C6. The A domain constitutes a ligand binding moiety. The cysteine residues of the domain are disulfide linked to form a compact, stable, functionally independent moiety. Clusters of these repeats make up a ligand binding domain, and differential clustering can impart specificity with respect to the ligand binding. Exemplary proteins containing A-domains include, e.g., complement components (e.g., C6, C7, C8, C9, and Factor I), serine proteases (e.g., enteropeptidase, matriptase, and corin), transmembrane proteins (e.g., ST7, LRP3, LRP5 and LRP6) and endocytic receptors (e.g. Sortilin-related receptor, LDL-receptor, VLDLR, LRP1, LRP2, and ApoER2). Methods for making A-domain proteins of a desired binding specificity are disclosed, for example, in WO 02/088171 and WO 04/044011.

As another example, in some cases, the non-antibody-based scaffold comprises a binding site from a repeat protein. Repeat proteins are proteins that contain consecutive copies of small (e.g., about 20 to about 40 amino acid residues) structural units or repeats that stack together to form contiguous domains. Repeat proteins can be modified to suit a particular target binding site by adjusting the number of repeats in the protein. Exemplary repeat proteins include designed ankyrin repeat proteins (i.e., a DARPins) (see e.g., Binz et al., Nat. Biotechnol., 22: 575-582 (2004)) or leucine-rich repeat proteins (i.e., LRRPs) (see e.g., Pancer et al., Nature, 430: 174-180 (2004)). As another example, in some cases, the non-antibody-based scaffold comprises a DARPin.

As used herein, the term "DARPin" refers to a genetically engineered antibody mimetic protein that typically exhibits highly specific and high-affinity target protein binding. DARPins were first derived from natural ankyrin proteins. In some cases, DARPins comprise three, four or five repeat motifs of an ankyrin protein. In some cases, a unit of an ankyrin repeat consists of 30-34 amino acid residues and functions to mediate protein-protein interactions. In some cases, each ankyrin repeat exhibits a helix-turn-helix conformation, and strings of such tandem repeats are packed in a nearly linear array to form helix-turn-helix bundles connected by relatively flexible loops. In some cases, the global structure of an ankyrin repeat protein is stabilized by intra- and inter-repeat hydrophobic and hydrogen bonding interactions. The repetitive and elongated nature of the ankyrin repeats provides the molecular bases for the unique characteristics of ankyrin repeat proteins in protein stability, folding and unfolding, and binding specificity. The molecular mass of a DARPin domain can be from about 14 or 18 kDa for four- or five-repeat DARPins, respectively. DARPins are described in, e.g., U.S. Pat. No. 7,417,130. In some cases, tertiary structures of ankyrin repeat units share a characteristic composed of a beta-hairpin followed by two antiparallel alpha-helices and ending with a loop connecting the repeat unit with the next one. Domains built of ankyrin repeat units can be formed by stacking the repeat units to an extended and curved structure. LRRP binding sites from part of the adaptive immune system of sea lampreys and other jawless fishes and resemble antibodies in that they are formed by recombination of a suite of leucine-rich repeat genes during lymphocyte maturation. Methods for making DARpin or LRRP binding sites are described in WO 02/20565 and WO 06/083275.

As another example, in some cases, the non-antibody-based scaffold comprises a binding site derived from Src homology domains (e.g. SH2 or SH3 domains), PDZ domains, beta-lactamase, high affinity protease inhibitors, or small disulfide binding protein scaffolds such as scorpion toxins. Methods for making binding sites derived from these molecules have been disclosed in the art, see e.g., Panni et al., J. Biol. Chem., 277: 21666-21674 (2002); Schneider et at, Nat. Biotechnol., 17: 170-175 (1999); Legendre et al., Protein Sci., 11:1506-1518 (2002); Stoop et al., Nat. Biotechnol., 21: 1063-1068 (2003); and Vita et al., PNAS, 92: 6404-6408 (1995). Yet other binding sites may be derived from a binding domain selected from the group consisting of an EGF-like domain, a Kringle-domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, a Laminin-type EGF-like domain, a C2 domain, a binding domain derived from tetranectin in its monomeric or trimeric form, and other such domains known to those of ordinary skill in the art, as well as derivatives and/or variants thereof. Exemplary non-antibody-based scaffolds, and methods of making the same, can also be found in Stemmer et al., "Protein scaffolds and uses thereof", U.S. Patent Publication No. 20060234299 (Oct. 19, 2006) and Hey, et al., Artificial, Non-Antibody Binding Proteins for Pharmaceutical and Industrial Applications, TRENDS in Biotechnology, vol. 23, No. 10, Table 2 and pp. 514-522 (October 2005).

As another example, in some cases, the non-antibody-based scaffold comprises a Kunitz domain. The term "Kunitz domains" as used herein, refers to conserved protein domains that inhibit certain proteases, e.g., serine proteases. Kunitz domains are relatively small, typically being about 50 to 60 amino acids long and having a molecular weight of about 6 kDa. Kunitz domains typically carry a basic charge and are characterized by the placement of two, four, six or eight or more that form disulfide linkages that contribute to the compact and stable nature of the folded peptide. For example, many Kunitz domains have six conserved cysteine residues that form three disulfide linkages. The disulfide-rich $\alpha/\beta$ fold of a Kunitz domain can include two, three (typically), or four or more disulfide bonds.

Kunitz domains have a pear-shaped structure that is stabilized the, e.g., three disulfide bonds, and that contains a reactive site region featuring the principal determinant P1 residue in a rigid confirmation. These inhibitors competitively prevent access of a target protein (e.g., a serine protease) for its physiologically relevant macromolecular substrate through insertion of the P1 residue into the active site cleft. The P1 residue in the proteinase-inhibitory loop provides the primary specificity determinant and dictates much of the inhibitory activity that particular Kunitz protein has toward a targeted proteinase. In general, the N-terminal side of the reactive site (P) is energetically more important that the P' C-terminal side. In most cases, lysine or arginine occupy the P1 position to inhibit proteinases that cleave adjacent to those residues in the protein substrate. Other residues, particularly in the inhibitor loop region, contribute to the strength of binding. Generally, about 10-12 amino acid residues in the target protein and 20-25 residues in the proteinase are in direct contact in the formation of a stable proteinase-inhibitor protein entity and provide a buried area of about 600 to 900 A. By modifying the residues in the P site and surrounding residues Kunitz domains can be designed to target a protein of choice. Kunitz domains are described in, e.g., U.S. Pat. No. 6,057,287.

As another example, in some cases, the non-antibody-based scaffold is an affilin. Affilins are small antibody-mimic proteins which are designed for specific affinities towards proteins and small compounds. New affilins can be very quickly selected from two libraries, each of which is based on a different human derived scaffold protein. Affilins do not show any structural homology to immunoglobulin proteins. There are two commonly-used affilin scaffolds, one of which is gamma crystalline, a human structural eye lens protein and the other is "ubiquitin" superfamily proteins. Both human scaffolds are very small, show high temperature stability and are almost resistant to pH changes and denaturing agents. This high stability is mainly due to the expanded beta sheet structure of the proteins. Examples of gamma crystalline derived proteins are described in WO200104144 and examples of "ubiquitin-like" proteins are described in WO2004106368.

As another example, in some cases, the non-antibody-based scaffold is an Avimer. Avimers are evolved from a large family of human extracellular receptor domains by in vitro exon shuffling and phage display, generating multidomain proteins with binding and inhibitory properties Linking multiple independent binding domains has been shown to create avidity and results in improved affinity and specificity compared with conventional single-epitope binding proteins. In certain embodiments, Avimers consist of two or more peptide sequences of 30 to 35 amino acids each, connected by spacer region peptides. The individual sequences are derived from A domains of various membrane receptors and have a rigid structure, stabilized by disulfide bonds and calcium. Each A domain can bind to a certain epitope of the target protein. The combination of domains binding to different epitopes of the same protein increases affinity to this protein, an effect known as avidity (hence the name). Avimers with sub-nanomolar affinities have been obtained against a variety of targets. Alternatively, the domains can be directed against epitopes on different target proteins. Additional information regarding avimers can be found in U.S. patent application Publication Nos. 2006/0286603, 2006/0234299, 2006/0223114, 2006/0177831, 2006/0008844, 2005/0221384, 2005/0164301, 2005/0089932, 2005/0053973, 2005/0048512, 2004/0175756.

Suitable targets of a non-antibody-based scaffold include any of the above-mentioned antigens to which an antibody-based scaffold can bind.

In some cases, the target (second member of the specific binding pair) bound by the non-antibody-based scaffold is soluble. In some cases, the target is membrane-bound, e.g., in some cases, the target is present on the surface of a cell. In some cases, the target is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the target is present in an extracellular matrix (ECM) (e.g., the antigen is an ECM component). In some cases, the target is present in an artificial matrix. In some cases, the target is present in an acellular environment.

Cell Adhesion Molecules

In some cases, the first member of the specific binding pair is a cell adhesion molecule (CAM), i.e., a polypeptide that binds a component of an extracellular matrix (ECM) or that binds a cell surface molecule. For example, in some cases, the first member of the specific binding pair is the extracellular region of a CAM. In some cases, the CAM is a calcium-independent adhesion molecule; for example, in some cases, the CAM is an immunoglobulin superfamily CAM. In some cases, the CAM is a calcium-dependent adhesion molecule; e.g., the CAM is an integrin, a cadherin, or a selectin. In some cases, the first member of the specific binding pair is an integrin. In some cases, the first member of the specific binding pair is a cadherin, e.g., an E-cadherin, a P-cadherin, an N-cadherin, an R-cadherin, an M-cadherin, etc. In some cases, the first member of the specific binding pair is a selectin, e.g., an E-selectin, an L-selectin, or a P-selectin. Binding fragments of a CAM can be used as the first member of the specific binding pair.

Where the first member of the specific binding pair is a CAM, the second member of the specific binding pair is a component of ECM or a cell surface molecule that binds the CAM. For example, where the first member of the specific binding pair is an integrin, the second member of the specific binding pair is a component of collagen, fibrinogen, fibronectin, or vitronectin. As another example, where the first member of the specific binding pair is cadherin, the second member of the specific binding pair is cell surface antigen bound by the cadherin. As another example, where the first member of the specific binding pair is a selectin, the second member of the specific binding pair is a fucosylated carbohydrate.

Ligands

In some cases, the first member of the specific binding pair is a ligand for a receptor. Ligands include polypeptides, nucleic acids, glycoproteins, small molecules, carbohydrates, lipids, glycolipids, lipoproteins, lipopolysaccharides, etc. In some cases, the ligand is soluble.

Ligands include, but are not limited to, cytokines (e.g., IL-13, etc.); growth factors (e.g., heregulin; vascular endothelial growth factor (VEGF); and the like); peptide hormones; an integrin-binding peptide (e.g., a peptide comprising the sequence Arg-Gly-Asp); an N-glycan; and the like.

Where the member of a specific binding pair in a conditionally active heterodimeric polypeptide of the present disclosure is a ligand, the conditionally active heterodimeric polypeptide can be activated in the presence of a second member of the specific binding pair, where the second member of the specific binding pair is a receptor for the ligand. For example, where the ligand is VEGF, the second member of the specific binding pair can be a VEGF receptor, including a soluble VEGF receptor. Alternatively, the first member of the specific binding pair can be a VEGF receptor; and the first member of the specific binding pair can be VEGF. As another example, where the ligand is heregulin, the second member of the specific binding pair can be Her2.

Where the first member of the specific binding pair is a ligand, the second member of the specific binding pair is a molecule that binds the ligand, e.g., the second member of the specific binding pair is an antibody that specifically binds the ligand, a receptor for the ligand, etc.

Where the first member of the specific binding pair is a ligand, in some cases, the second member of the specific binding pair (the molecule that binds the ligand) is soluble. In some cases, the second member of the specific binding pair is membrane-bound, e.g., in some cases, the second member of the specific binding pair is present on the surface of a cell. In some cases, the second member of the specific binding pair is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the second member of the specific binding pair is present in an acellular environment.

Antigens

In some cases, the first member of the specific binding pair is an antigen to which an antibody specifically binds. The antigen can be any antigen, e.g., a naturally-occurring (endogenous) antigen; a synthetic (e.g., modified in such a way that it is no longer the same as a naturally-occurring antigen; modified from its natural state; etc.) antigen; etc.

Where the member of a specific binding pair in a conditionally active heterodimeric polypeptide of the present disclosure is an antigen, the conditionally active heterodimeric polypeptide can be activated in the presence of a second member of the specific binding pair, where the second member of the specific binding pair is an antibody (antibody-based recognition scaffold) that binds to the antigen.

In some cases, the antigen is a disease-associated antigen, e.g., a cancer-associated antigen, an autoimmune disease-associated antigen, a pathogen-associated antigen, an inflammation-associated antigen, or the like.

For example, where the second member of the specific binding pair is an antibody specific for a cancer-associated antigen, the antigen can be a cancer-associated antigen, where cancer-associated antigens include, e.g., CD19, CD20, CD38, CD30, Her2/neu/ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Cancer-associated antigens also include, e.g., 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CEA, CNTO888, CTLA-4, DR5, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin α5β1, integrin αvβ3, MORAb-009, MS4A1, MUC1, mucin CanAg, N-glycolylneuraminic acid, NPC-1C, PDGF-R α, PDL192, phosphatidylserine, prostatic carcinoma cells, RANKL, RON, ROR1, SCH 900105, SDC1, SLAMF7, TAG-72, tenascin C, TGF beta 2, TGF-β, TRAIL-R1, TRAIL-R2, tumor antigen CTAA16.88, VEGF-A, VEGFR-1, VEGFR2, and vimentin.

The antigen can be associated with an inflammatory disease. Non-limiting examples of antigens associated with inflammatory disease include, e.g., AOC3 (VAP-1), CAM-3001, CCL11 (eotaxin-1), CD125, CD147 (basigin), CD154 (CD40L), CD2, CD20, CD23 (IgE receptor), CD25 (a chain of IL-2 receptor), CD3, CD4, CD5, IFN-α, IFN-γ, IgE, IgE Fc region, IL-1, IL-12, IL-23, IL-13, IL-17, IL-17A, IL-22, IL-4, IL-5, IL-5, IL-6, IL-6 receptor, integrin α4, integrin α4β7, LFA-1 (CD11a), myostatin, OX-40, scleroscin, SOST, TGF beta 1, TNF-α, and VEGF-A.

Where the first member of the specific binding pair is an antigen, the second member of the specific binding pair can be an antibody-based scaffold (e.g., an antibody) or a non-antibody-based scaffold. In some cases, the second member of the specific binding pair is present on the surface of a cell. In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Targets of Non-Antibody-Based Recognition Scaffolds

In some cases, the first member of the specific binding pair is a target of a non-antibody-based scaffold. Targets include, e.g., polypeptides, nucleic acids, glycoproteins, small molecules, carbohydrates, lipids, glycolipids, lipoproteins, lipopolysaccharides, etc.

Where the first member of the specific binding pair is a target of a non-antibody-based scaffold, the second member of the specific binding pair is a non-antibody-based scaffold.

Receptors

In some cases, the first member of the specific binding pair is a receptor. In some cases, the receptor is a growth factor receptor. In some cases, the receptor is a cytokine receptor. In some cases, the receptor is a cell surface receptor that binds to a co-receptor on a cell. In some cases, the receptor is a neurotransmitter receptor. In some cases, the receptor binds to an extracellular matrix component. In some cases, the receptor is an immunoglobulin Fc receptor.

Suitable receptors include, but are not limited to, a growth factor receptor (e.g., a VEGF receptor); a killer cell lectin-like receptor subfamily K, member 1 (NKG2D) polypeptide (receptor for MICA, MICB, and ULB6); a cytokine receptor (e.g., an IL-13 receptor; an IL-2 receptor; etc.); an epidermal growth factor (EGF) receptor; Her2; CD27; a natural cytotoxicity receptor (NCR) (e.g., NKP30 (NCR3/CD337) polypeptide (receptor for HLA-B—associated transcript 3 (BAT3) and B7-H6); etc.); a T cell antigen receptor; a dihydrofolate receptor; a chimeric cytokine receptor; an Fc receptor; an extracellular matrix receptor (e.g. an integrin); a cell adhesion receptor (e.g. a cadherin); an immunoregulatory receptor including both positive co-receptors (e.g. CD28) and negative (immunosuppressive) co-receptors (e.g., PD1); a cytokine receptor; and a receptor for a immunoregulatory molecule (e.g. TGFβ), etc. In some cases, the receptor is truncated, relative to the wild-type receptor.

Where the first member of the specific binding pair is a receptor, the second member of the specific binding pair is target of the receptor, where the target can be a ligand for the receptor, or a co-receptor. In some cases, the second member of the specific binding pair is present on the surface of a cell. In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Hinge Region

In some cases, the first polypeptide of a subject conditionally active heterodimeric polypeptide comprises a hinge region (also referred to herein as a "spacer"), where the hinge region is interposed between the antigen-binding domain and the transmembrane domain. In some cases, the hinge region is an immunoglobulin heavy chain hinge region. In some cases, the hinge region is a hinge region polypeptide derived from a receptor (e.g., a CD8-derived hinge region).

The hinge region can have a length of from about 4 amino acids to about 50 amino acids, e.g., from about 4 aa to about 10 aa, from about 10 aa to about 15 aa, from about 15 aa to about 20 aa, from about 20 aa to about 25 aa, from about 25 aa to about 30 aa, from about 30 aa to about 40 aa, or from about 40 aa to about 50 aa.

Suitable spacers can be readily selected and can be of any of a number of suitable lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and can be 1, 2, 3, 4, 5, 6, or 7 amino acids.

Exemplary spacers include glycine polymers $(G)_n$, glycine-serine polymers (including, for example, $(GS)_n$, $(GSGGS)_n$ (SEQ ID NO:516) and $(GGGS)_n$ (SEQ ID NO:517), where n is an integer of at least one), glycine-alanine polymers, alanine-serine polymers, and other flexible linkers known in the art. Glycine and glycine-serine polymers can be used; both Gly and Ser are relatively unstructured, and therefore can serve as a neutral tether between components. Glycine polymers can be used; glycine accesses significantly more phi-psi space than even alanine, and is much less restricted than residues with longer side chains (see Scheraga, *Rev. Computational Chem.* 11173-142 (1992)). Exemplary spacers can comprise amino acid sequences including, but not limited to, GGSG (SEQ ID NO:518), GGSGG (SEQ ID NO:519), GSGSG (SEQ ID NO:520), GSGGG (SEQ ID NO:521), GGGSG (SEQ ID NO:522), GSSSG (SEQ ID NO:523), and the like.

In some cases, the hinge region in the first polypeptide of a subject conditionally active heterodimeric polypeptide includes at least one cysteine. For example, in some cases, the hinge region can include the sequence Cys-Pro-Pro-Cys. If present, a cysteine in the hinge region of a first conditionally active heterodimeric polypeptide can be available to form a disulfide bond with a hinge region in a second conditionally active heterodimeric polypeptide.

Immunoglobulin hinge region amino acid sequences are known in the art; see, e.g., Tan et al. (1990) *Proc. Natl. Acad. Sci. USA* 87:162; and Huck et al. (1986) *Nucl. Acids Res.* 14:1779. As non-limiting examples, an immunoglobulin hinge region can include one of the following amino acid sequences: DKTHT (SEQ ID NO:524); CPPC (SEQ ID NO:525); CPEPKSCDTPPPCPR (SEQ ID NO:526) (see, e.g., Glaser et al. (2005) *J. Biol. Chem.* 280:41494); ELKTPLGDTTHT (SEQ ID NO:527); KSCDKTHTCP (SEQ ID NO:528); KCCVDCP (SEQ ID NO:529); KYGPPCP (SEQ ID NO:530); EPKSCDKTHTCPPCP (SEQ ID NO:531) (human IgG1 hinge); ERKCCVECPPCP (SEQ ID NO:532) (human IgG2 hinge); ELKTPLGDTTH-TCPRCP (SEQ ID NO:533) (human IgG3 hinge); SPNMVPHAHHAQ (SEQ ID NO:534) (human IgG4 hinge); and the like.

The hinge region can comprise an amino acid sequence of a human IgG1, IgG2, IgG3, or IgG4, hinge region. The hinge region can include one or more amino acid substitutions and/or insertions and/or deletions compared to a wild-type (naturally-occurring) hinge region. For example, $His_{229}$ of human IgG1 hinge can be substituted with Tyr, so that the hinge region comprises the sequence EPKSCDKTYTCPPCP (SEQ ID NO:535); see, e.g., Yan et al. (2012) *J. Biol. Chem.* 287:5891.

The hinge region can comprise an amino acid sequence derived from human CD8; e.g., the hinge region can comprise the amino acid sequence: TTTPAPRPPTPAPTIA-SQPLSLRPEACRPAAGGAVHTRGLDFACD (SEQ ID NO:536), or a variant thereof.

Transmembrane Domain

The first and the second polypeptides of a CAR of the present disclosure include transmembrane domains for insertion into a eukaryotic cell membrane. The transmembrane domain of the first polypeptide is interposed between the antigen-binding domain and the co-stimulatory domain. Where the first polypeptide includes a hinge region, the transmembrane domain is interposed between the hinge region and the co-stimulatory domain, such that the first polypeptide comprises, in order from the amino terminus (N-terminus) to the carboxyl terminus (C-terminus): an antigen-binding domain; a hinge region; a transmembrane domain; a first co-stimulatory domain; and a first member of a dimerizer-binding pair.

The transmembrane domain of the second polypeptide is at or near the N-terminus of the polypeptide, such that the second polypeptide comprises, in order from N-terminus to C-terminus: a transmembrane domain; a second co-stimulatory domain; a second member of the dimerizer-binding pair; and an intracellular signaling domain.

Any transmembrane (TM) domain that provides for insertion of a polypeptide into the cell membrane of a eukaryotic (e.g., mammalian) cell is suitable for use. As one non-limiting example, the TM sequence IYI-WAPLAGTCGVLLLSLVITLYC (SEQ ID NO:537) can be used. Additional non-limiting examples of suitable TM sequences include: a) CD8 beta derived: LGLL-VAGVLVLLVSLGVAIHLCC (SEQ ID NO:538); b) CD4 derived: ALIVLGGVAGLLLFIGLGIFFCVRC (SEQ ID NO:539); c) CD3 zeta derived: LCYLLDGILFIYGVILT-ALFLRV (SEQ ID NO:540); d) CD28 derived: WVLVVVGGVLACYSLLVTVAFIIFWV (SEQ ID NO:541); e) CD134 (OX40) derived: VAAILGLGLVLGLLGPLAILLALYLL (SEQ ID NO:542); and f) CD7 derived: ALPAALAVISFLLGLGLGVACVLA (SEQ ID NO:543).

Linkers

In some cases, a first polypeptide of a subject CAR includes a linker between any two adjacent domains. For example, a linker can be disposed between the transmembrane domain and the first co-stimulatory domain of the first polypeptide. As another example, a linker can be disposed between the first co-stimulatory domain and the first member of a dimerizer-binding pair of the first polypeptide. As another example, a linker can be disposed between the transmembrane domain and the second co-stimulatory domain of the second polypeptide. As another example, a linker can be disposed between the second co-stimulatory domain and the second member of the dimerizer-binding pair of the second polypeptide. As another example, a linker can be disposed between the second member of the dimerizer-binding pair and the intracellular signaling domain of the second polypeptide.

The linker peptide may have any of a variety of amino acid sequences. Proteins can be joined by a spacer peptide, generally of a flexible nature, although other chemical linkages are not excluded. A linker can be a peptide of between about 6 and about 40 amino acids in length, or between about 6 and about 25 amino acids in length. These linkers can be produced by using synthetic, linker-encoding oligonucleotides to couple the proteins. Peptide linkers with a degree of flexibility can be used. The linking peptides may have virtually any amino acid sequence, bearing in mind that suitable linkers will have a sequence that results in a generally flexible peptide. The use of small amino acids, such as glycine and alanine, are of use in creating a flexible peptide. The creation of such sequences is routine to those of skill in the art.

Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, or 7 amino acids.

Exemplary flexible linkers include glycine polymers $(G)_n$, glycine-serine polymers (including, for example, $(GS)_n$, $GSGGS_n$ (SEQ ID NO:516) and $GGGS_n$ (SEQ ID NO:517), where n is an integer of at least one), glycine-alanine polymers, alanine-serine polymers, and other flexible linkers known in the art. Glycine and glycine-serine polymers are of interest since both of these amino acids are relatively unstructured, and therefore may serve as a neutral tether between components. Glycine polymers are of particular interest since glycine accesses significantly more phi-psi space than even alanine, and is much less restricted than residues with longer side chains (see Scheraga, *Rev. Computational Chem.* 11173-142 (1992)). Exemplary flexible linkers include, but are not limited GGSG (SEQ ID NO:518), GGSGG (SEQ ID NO:519), GSGSG (SEQ ID NO:520), GSGGG (SEQ ID NO:521), GGGSG (SEQ ID NO:522), GSSSG (SEQ ID NO:523), and the like. The ordinarily skilled artisan will recognize that design of a peptide conjugated to any elements described above can include linkers that are all or partially flexible, such that the linker can include a flexible linker as well as one or more portions that confer less flexible structure.

Modulatory Domains

Modulatory domains suitable for use in a CAR of the present disclosure include co-stimulatory domains. Modulatory domains may be present or absent in a subject conditionally active heterodimeric polypeptide of the present disclosure. As such, a particular conditionally active heterodimeric polypeptide of the present disclosure (or one or more polypeptide chains of a multichain conditionally active heterodimeric polypeptide of the present disclosure) may include anywhere from 0 to 6 or more modulatory domains. For example, in some instances, the polypeptide chains of a conditionally active heterodimeric polypeptide of the present disclosure may collectively include 0, 1, 2, 3, 4, 5, 6 or more modulatory domains. In some instances, a polypeptide chain of a conditionally active heterodimeric polypeptide of the present disclosure may individually include 0, 1, 2, 3, 4, 5, 6 or more modulatory domains. A particular modulatory domain may be present in one polypeptide chain of a conditionally active heterodimeric polypeptide but absent from another. In some instances, a particular modulatory domain may be present in both chains of a two chain conditionally active heterodimeric polypeptide. Furthermore, position of a modulatory domains on or within a polypeptide may vary greatly as a particular modulatory domain may be positioned at an end (e.g., the N-terminal or C-terminal end) of the polypeptide or essentially any appropriate position within the polypeptide, e.g., adjacent to a transmembrane domain, adjacent to an intracellular signaling domain, adjacent to one or more other modulatory domains, etc.

In some cases, the modulatory domain on the first polypeptide of a subject CAR has substantially the same amino acid sequence as the modulatory domain on the second polypeptide of the CAR. For example, in some cases, the modulatory domain on the first polypeptide of a CAR comprises an amino acid sequence that is at least about 90%, at least about 95%, at least about 98%, at least about 99%, or 100%, identical to the amino acid sequence of the modulatory domain on the second polypeptide of the CAR. The modulatory domain of the first polypeptide of a subject CAR can have substantially the same length as the modulatory domain of the second polypeptide of a subject CAR; e.g., the first and second modulatory domains can differ in length from one another by fewer than 10 amino acids, or fewer than 5 amino acids. In some cases, the first and second modulatory domains have the same length.

A modulatory domain suitable for inclusion in the first and the second polypeptide of a subject CAR can have a length of from about 30 amino acids to about 70 amino acids (aa), e.g., a modulatory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, modulatory domain can have a length of from about 70 aa to about 100 aa, from about 100 aa to about 200 aa, or greater than 200 aa.

Co-stimulatory domains suitable for use in a CAR of the present disclosure are generally polypeptides derived from receptors. In some embodiments, co-stimulatory domains homodimerize. A subject co-stimulatory domain can be an intracellular portion of a transmembrane protein (i.e., the co-stimulatory domain can be derived from a transmembrane protein). Non-limiting examples of suitable co-stimulatory polypeptides include, but are not limited to, 4-1BB (CD137), CD28, ICOS, OX-40, BTLA, CD27, CD30, GITR, and HVEM.

In some cases, the co-stimulatory domain on the first polypeptide of a subject CAR has substantially the same amino acid sequence as the co-stimulatory domain on the second polypeptide of the CAR. For example, in some cases, the co-stimulatory domain on the first polypeptide of a CAR comprises an amino acid sequence that is at least about 90%, at least about 95%, at least about 98%, at least about 99%, or 100%, identical to the amino acid sequence of the co-stimulatory domain on the second polypeptide of the CAR. The co-stimulatory domain of the first polypeptide of a subject CAR can have substantially the same length as the co-stimulatory domain of the second polypeptide of a subject CAR; e.g., the first and second co-stimulatory domains can differ in length from one another by fewer than 10 amino acids, or fewer than 5 amino acids. In some cases, the first and second co-stimulatory domains have the same length.

A co-stimulatory domain suitable for inclusion in the first and the second polypeptide of a subject CAR can have a length of from about 30 amino acids to about 70 amino acids (aa), e.g., a co-stimulatory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, the co-stimulatory domain can have a length of from about 70 aa to about 100 aa, from about 100 aa to about 200 aa, or greater than 200 aa.

In some cases, the co-stimulatory domain is derived from an intracellular portion of the transmembrane protein 4-1BB (also known as TNFRSF9; CD137; 4-1BB; CDw137; ILA; etc.). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: KRGRKKLLY-IFKQPFMRPVQTTQEEDGCSCRFPEEEEGGCEL (SEQ ID NO:544). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain is derived from an intracellular portion of the transmembrane protein CD28 (also known as Tp44). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: FWVRSKRSRLLHSDYMNMTPRRPGP-TRKHYQPYAPPRDFAAYRS (SEQ ID NO:545). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain is derived from an intracellular portion of the transmembrane protein ICOS (also known as AILIM, CD278, and CVID1). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: TKKKYSSSVHDPNG-EYMFMRAVNTAKKSRLTDVTL (SEQ ID NO:546). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain is derived from an intracellular portion of the transmembrane protein OX-40 (also known as TNFRSF4, RP5-902P8.3, ACT35, CD134, OX40, TXGP1L). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: RRDQRLPPDAHKPPGGGSFRTPIQEEQA-DAHSTLAKI (SEQ ID NO:547). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain is derived from an intracellular portion of the transmembrane protein BTLA (also known as BTLA1 and CD272). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence:

(SEQ ID NO: 548)
CCLRRHQGKQNELSDTAGREINLVDAHLKSEQTEASTRQNSQVLLSETG
IYDNDPDLCFRMQEGSEVYSNPCLEENKPGIVYASLNHSVIGPNSRLAR
NVKEAPTEYASICVRS.

In some cases, the co-stimulatory domain is derived from an intracellular portion of the transmembrane protein CD27 (also known as S152, T14, TNFRSF7, and Tp55). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HQRRKYRSNKGESPVEPAEPCRYSCPREEEGSTIP-IQEDYRKPEPACSP (SEQ ID NO:549). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain is derived from an intracellular portion of the transmembrane protein CD30 (also known as TNFRSF8, D1S166E, and Ki-1). For example, a suitable co-stimulatory domain can comprise an amino acid sequence having at least about 75%, at least about 80%, at least about 85%, at least about 90%, at least about 95%, at least about 98%, or 100% amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, from about 150 aa to about 160 aa, or from about 160 aa to about 185 aa of the following amino acid sequence:

(SEQ ID NO: 550)
RRACRKRIRQKLHLCYPVQTSQPKLELVDSRPRRSSTQLRSGASVTEPVAE

ERGLMSQPLMETCHSVGAAYLESLPLQDASPAGGPSSPRDLPEPRVSTEHT

NNKIEKIYIMKADTVIVGTVKAELPEGRGLAGPAEPELEEELEADHTPHYP

EQETEPPLGSCSDVMLSVEEEGKEDPLPTAASGK.

In some cases, the co-stimulatory domain is derived from an intracellular portion of the transmembrane protein GITR (also known as TNFRSF18, RP5-902P8.2, AITR, CD357, and GITR-D). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HIWQLRSQCMWPRETQLLLEVPPSTE-DARSCQFPEEERGERSAEEKGRLGDLWV (SEQ ID NO:551). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some cases, the co-stimulatory domain derived from an intracellular portion of the transmembrane protein HVEM (also known as TNFRSF14, RP3-395M20.6, ATAR, CD270, HVEA, HVEM, LIGHTR, and TR2). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: CVKRRKPRGDVVKVIVSVQRKRQEAEGEAT-VIEALQAPPDVTTVAVEETIPSFTGRSPNH (SEQ ID NO:552). In some of these embodiments, the co-stimulatory domain of both the first and the second polypeptide has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

Dimerization Pairs

As noted above, a conditionally active, heterodimeric polypeptide of the present disclosure comprises two polypeptide chains, one of which comprises a first member of a dimerization pair, and the second of which comprises a second member of a dimerization pair. One of the members of the dimerization pair will comprise a ligand-binding domain (LBD) of a nuclear hormone receptor; the other member of the dimerization pair will comprise a co-regulator peptide of the same nuclear hormone receptor. In the presence of a dimerization agent (e.g., a nuclear hormone, or a functional derivative or analog of the nuclear hormone; also referred to herein as a "dimerizer"), the first and second members of the dimerization pair will bind to one another, and will effect dimerization of the two polypeptide chains of the conditionally active, heterodimeric polypeptide of the present disclosure. A first member of a dimerization pair, or a second member of a dimerization pair, can also be referred to as a "dimerization domain."

Ligand-Binding Domain (LBD)

A ligand-binding domain of a nuclear hormone receptor can be from any of a variety of nuclear hormone receptors, including, but not limited to, ERα, ERβ, PR, AR, GR, MR, RARα, RARβ, RARγ, TRα, TRβ, VDR, EcR, RXRα, RXRβ, RXRγ, PPARα, PPARβ, PPARγ, LXRα, LXRβ, FXR, PXR, SXR, CAR, SF-1, LRH-1, DAX-1, SHP, TLX, PNR, NGF1-Bα, NGF1-Bβ, NGF1-Bγ, RORα, RORβ, RORγ, ERRα, ERRβ, ERRγ, GCNF, TR2/4, HNF-4, COUP-TFα, COUP-TFβ and COUP-TFγ.

Abbreviations for nuclear hormone receptors are as follows. ER: Estrogen Receptor; PR: Progesterone Receptor; AR: Androgen Receptor; GR: Glucocorticoid Receptor; MR: Mineralocorticoid Receptor; RAR: Retinoic Acid Receptor; TRα, β: Thyroid Receptor; VDR: Vitamin D3 Receptor; EcR: Ecdysone Receptor; RXR: Retinoic Acid X Receptor; PPAR: Peroxisome Proliferator Activated Receptor; LXR: Liver X Receptor; FXR: Farnesoid X Receptor; PXR/SXR: Pregnane X Receptor/Steroid and Xenobiotic Receptor; CAR: Constitutive Adrostrane Receptor; SF-1: Steroidogenic Factor 1; DAX-1: Dosage sensitive sex reversal-adrenal hypoplasia congenital critical region on the X chromosome, gene 1; LRH-1: Liver Receptor Homolog 1; SHP: Small Heterodimer Partner; TLX: Tail-less Gene; PNR: Photoreceptor-Specific Nuclear Receptor; NGF1-B: Nerve Growth Factor; ROR: RAR related orphan receptor; ERR: Estrogen Related Receptor; GCNF: Germ Cell Nuclear Factor; TR2/4: Testicular Receptor; HNF-4: Hepatocyte Nuclear Factor; COUP-TF: Chicken Ovalbumin Upstream Promoter, Transcription Factor.

In some cases, a polypeptide chain of a heterodimeric polypeptide of the present disclosure comprises a single LBD of a nuclear hormone receptor. In some cases, a polypeptide chain of a heterodimeric polypeptide of the present disclosure comprises multiple (two or more) LBD of a nuclear hormone receptor. In some cases, a polypeptide chain of a heterodimeric polypeptide of the present disclosure comprises two LBD of a nuclear hormone receptor. In some cases, a polypeptide chain of a heterodimeric polypeptide of the present disclosure comprises three LBD of a nuclear hormone receptor. Where a polypeptide chain of a heterodimeric polypeptide of the present disclosure comprises multiple (two or more) LBD of a nuclear hormone receptor, in some cases the multiple LBD comprise identical amino acid sequences. In some cases, the two or more LBD are in tandem, either directly or separated by a linker.

Mineralocorticoid Receptor

In some cases, an LBD suitable for inclusion as a member of a dimerization pair of a conditionally active, heterodimeric polypeptide of the present disclosure is an LBD of a mineralocorticoid receptor (MR). For example, in some cases, the LBD comprises an amino acid sequence having at least 75%, at least 80%, at least 85%, at least 90%, at least 95%, at least 98%, at least 99%, or 100%, amino acid sequence identity to the LBD of an MR having the amino acid sequence depicted in FIG. 1A.

As one non-limiting example, the LBD of a MR can comprise an amino acid sequence having at least 75%, at least 80%, at least 85%, at least 90%, at least 95%, at least 98%, at least 99%, or 100%, amino acid sequence identity to an amino acid sequence depicted in FIG. 1F; and has a length of from about 200 amino acids to 250 amino acids (e.g., has a length of from 200 amino acids to 225 amino acids, or from 225 amino acids to 250 amino acids; e.g., has a length of 248 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1B; and has a length of from about 250 amino acids to 299 amino acids (e.g., has a length of from 250 amino acids to 275 amino acids, or from 275 amino acids to 299 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1C; and has a length of from about 200 amino acids to 250 amino acids (e.g., has a length of from 200 amino acids to 225 amino acids, or from 225 amino acids to 250 amino acids; e.g., has a length of 248 amino acids).

As another non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1D, and has an S810L substitution (where the amino acid numbering is based on the amino acid sequence depicted in FIG. 1A); and has a length of from about 250 amino acids to 299 amino acids (e.g., has a length of from 250 amino acids to 275 amino acids, or from 275 amino acids to 299 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1C, and has an S810L substitution (where the amino acid numbering is based on the amino acid sequence depicted in FIG. 1A); and has a length of from about 200 amino acids to 250 amino acids (e.g., has a length of from 200 amino acids to 225 amino acids, or from 225 amino acids to 250 amino acids; e.g., has a length of 248 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence SLTARH-KILHRLLQEGSPSDI (SEQ ID NO:2), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence SLTARHKILHRLLQEGSPSDI (SEQ ID NO:2), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence QEAEEPSLLKKLL-LAPANTQL (SEQ ID NO:6), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence QEAEEPSLLKKLLLAPANTQL (SEQ ID NO:6), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence SKVSQNPILT-SLLQITGNGGS (SEQ ID NO:7), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence SKVSQNPILT-SLLQITGNGGS (SEQ ID NO:7), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Androgen Receptor

In some cases, an LBD suitable for inclusion as a member of a dimerization pair of a conditionally active, heterodimeric polypeptide of the present disclosure is an LBD of an androgen receptor (AR). For example, in some cases, the LBD comprises an amino acid sequence having at least 75%, at least 80%, at least 85%, at least 90%, at least 95%, at least 98%, at least 99%, or 100%, amino acid sequence identity to the LBD of an AR having the amino acid sequence depicted in FIG. 2A.

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B; and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C; and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has a T877A substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has a T877A substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has an F876L substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has an F876L substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has a T877A and an F876L substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has a T877A and an F876L substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

In some cases, where the first member of a dimerization pair of a conditionally active, heterodimeric polypeptide of the present disclosure is an LBD of an AR, the second member of the dimerization pair is a co-regulator peptide comprising the amino acid sequence ESKGHKKLLQLLTCSSDDR (SEQ ID NO:3), where the co-regulator peptide has a length of from about 19 amino acids to about 50 amino acids (e.g., the co-regulator peptide has a length of from 19 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an AR, the first member of the dimerization pair is a co-regulator peptide comprising the amino acid sequence ESKGHKKLLQLLTCSSDDR (SEQ ID NO:3), where the co-regulator peptide has a length of from about 19 amino acids to about 50 amino acids (e.g., the co-regulator peptide has a length of from 19 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Progesterone Receptor

In some cases, an LBD suitable for inclusion as a member of a dimerization pair of a conditionally active, heterodimeric polypeptide of the present disclosure is an LBD of a progesterone receptor (PR). For example, in some cases, the LBD comprises an amino acid sequence having at least 75%, at least 80%, at least 85%, at least 90%, at least 95%, at least 98%, at least 99%, or 100%, amino acid sequence identity to the LBD of a PR having the amino acid sequence depicted in FIG. 3A.

As one non-limiting example, the LBD of a PR can comprise an amino acid sequence having at least 75%, at least 80%, at least 85%, at least 90%, at least 95%, at least 98%, at least 99%, or 100%, amino acid sequence identity to an amino acid sequence depicted in FIG. 3D; and has a length of from about 200 amino acids to 250 amino acids (e.g., has a length of from 200 amino acids to 225 amino acids, or from 225 amino acids to 250 amino acids; e.g., has a length of 248 amino acids).

As one non-limiting example, the LBD of a PR can comprise an amino acid sequence having at least 75%, at least 80%, at least 85%, at least 90%, at least 95%, at least 98%, at least 99%, or 100%, amino acid sequence identity to the amino acid sequence depicted in FIG. 3B; and has a length of from about 200 amino acids to 256 amino acids (e.g., has a length of from 200 amino acids to 225 amino acids, or from 225 amino acids to 256 amino acids; e.g., has a length of 256 amino acids).

As one non-limiting example, the LBD of a PR can comprise an amino acid sequence having at least 75%, at least 80%, at least 85%, at least 90%, at least 95%, at least 98%, at least 99%, or 100%, amino acid sequence identity to the amino acid sequence depicted in FIG. 3C; and has a length of from about 200 amino acids to 250 amino acids (e.g., has a length of from 200 amino acids to 225 amino acids, or from 225 amino acids to 250 amino acids; e.g., has a length of 248 amino acids).

In some cases, where the first member of a dimerization pair of a conditionally active, heterodimeric polypeptide of the present disclosure is an LBD of a PR, the second member of the dimerization pair is a co-regulator peptide comprising the amino acid sequence GHSFADPASNLGLEDIIRKA-LMGSF (SEQ ID NO:8), where the co-regulator peptide has a length of from about 25 amino acids to about 50 amino acids (e.g., the co-regulator peptide has a length of from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PR, the first member of the dimerization pair is a co-regulator peptide comprising the amino acid sequence GHSFADPASNLGLEDIIRKALMGSF (SEQ ID NO:8), where the co-regulator peptide has a length of from about 25 amino acids to about 50 amino acids (e.g., the co-regulator peptide has a length of from 25 amino acids to 30 amino acids, from 30 amino acids to 35 amino acids, from 35 amino acids to 40 amino acids, from 40 amino acids to 45 amino acids, or from 45 amino acids to 50 amino acids).

Thyroid Hormone Receptor-β

In some cases, an LBD suitable for inclusion as a member of a dimerization pair of a conditionally active, heterodimeric polypeptide of the present disclosure is an LBD of thyroid hormone receptor-beta (TRβ). For example, in some cases, the LBD comprises an amino acid sequence having at least 75%, at least 80%, at least 85%, at least 90%, at least 95%, at least 98%, at least 99%, or 100%, amino acid sequence identity to the LBD of a TRβ having the amino acid sequence depicted in FIG. 4A.

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 4D; and has a length of from about 200 amino acids to 250 amino acids (e.g., has a length of from 200 amino acids to 225 amino acids, from 225 amino acids to 230 amino acids, from 230 amino acids to 240 amino acids, or from 240 amino acids to 250 amino acids).

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to the amino acid sequence depicted in FIG. 4B; and has a length of from about 200 amino acids to 260 amino acids (e.g., has a length of from 200 amino acids to 225 amino acids, or from 225 amino acids to 260 amino acids; e.g., has a length of 260 amino acids).

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to the amino acid sequence depicted in FIG. 4B; and has a length of from about 200 amino acids to 246 amino acids (e.g., has a length of from 200 amino acids to 225 amino acids, or from 225 amino acids to 246 amino acids; e.g., has a length of 246 amino acids).

In some cases, where the first member of a dimerization pair of a conditionally active, heterodimeric polypeptide of the present disclosure is an LBD of a TRβ, the second member of the dimerization pair is an NCOA3/SRC3 polypeptide. For example, in some cases, where the first member of a dimerization pair of a conditionally active, heterodimeric polypeptide of the present disclosure is an LBD of a TRβ, the second member of the dimerization pair is a co-regulator peptide comprises the amino acid sequence CSSDDRGHSSLTNSPLDSSCKESSVSVTSPSGVSSST-SGGVSSTSNMHGSLLQEKHRILHKLLQNG NSPAEVA-KITAEATGKDTSSITSCGDGNVVKQEQLSPKKKEN-NALLRYLLDRDDPSDALSKELQ PQVEGVDNKMSQCTSSTIPSSSQEKDPKIKTET-SEEGSGDLDNLDAILGDLTSSDFYNNSISSNGS HLGTKQQ (SEQ ID NO:553). In other cases, where the second member of a dimerization pair of a conditionally active, heterodimeric polypeptide of the present disclosure is an LBD of a TRβ, the first member of the dimerization pair is an NCOA3/SRC3 polypeptide. In some cases, the co-regulator peptide comprises the amino acid sequence:

(SEQ ID NO: 554)
MHGSLLQEKHRILHKLLQNGNSPAEVAKITAEATGKDTSSITSCGDGNV
VKQEQLSPKKKENNALLRYLLDRDDPSDA.

In some cases, where the first member of a dimerization pair of a conditionally active, heterodimeric polypeptide of the present disclosure is an LBD of a TRβ, the second member of the dimerization pair is an NCOA2/SRC2 polypeptide. For example, in some cases, where the first member of a dimerization pair of a conditionally active, heterodimeric polypeptide of the present disclosure is an LBD of a TRβ, the second member of the dimerization pair is a co-regulator peptide comprises the amino acid sequence STAPGSEVTIKQEPVSPKKKENALLRYLLDKDDTK-DIGLPEITPKLERLDSKTDPASNTKLIAMKT EKEEMS-FEPGDQPGDELDNLEEILDDLQNSQLPQLFPDTRP-GAPAGSVDKQAIINDLMQLTAENS PVTPVGAQKTALRISQSTFNNPRPGQL-GRLLPNQNLPLDITLQSPTGAGPFPPIRN-SSPYSVIPQPG MMGNQGMIGNQGNLGNSSTGMIGN-SASRPTMPSGEWAPQSSAVRVTCAATTSAMNRPVQG-GMIRNPAASIPMRPSSQPGQRQTLQSQVM-NIGPSELEMNMGGP (SEQ ID NO:555). In some cases, where the second member of a dimerization pair of a conditionally active, heterodimeric polypeptide of the present disclosure is an LBD of a TRβ, the first member of the dimerization pair is an NCOA2/SRC2 polypeptide.

Estrogen Receptor-Alpha

In some cases, an LBD suitable for inclusion as a member of a dimerization pair of a conditionally active, heterodimeric polypeptide of the present disclosure is an LBD of estrogen receptor-alpha (ERα). For example, in some cases, the LBD comprises an amino acid sequence having at least 75%, at least 80%, at least 85%, at least 90%, at least 95%, at least 98%, at least 99%, or 100%, amino acid sequence identity to the LBD of an ERα having the amino acid sequence depicted in FIG. 5A.

Figure 5H:
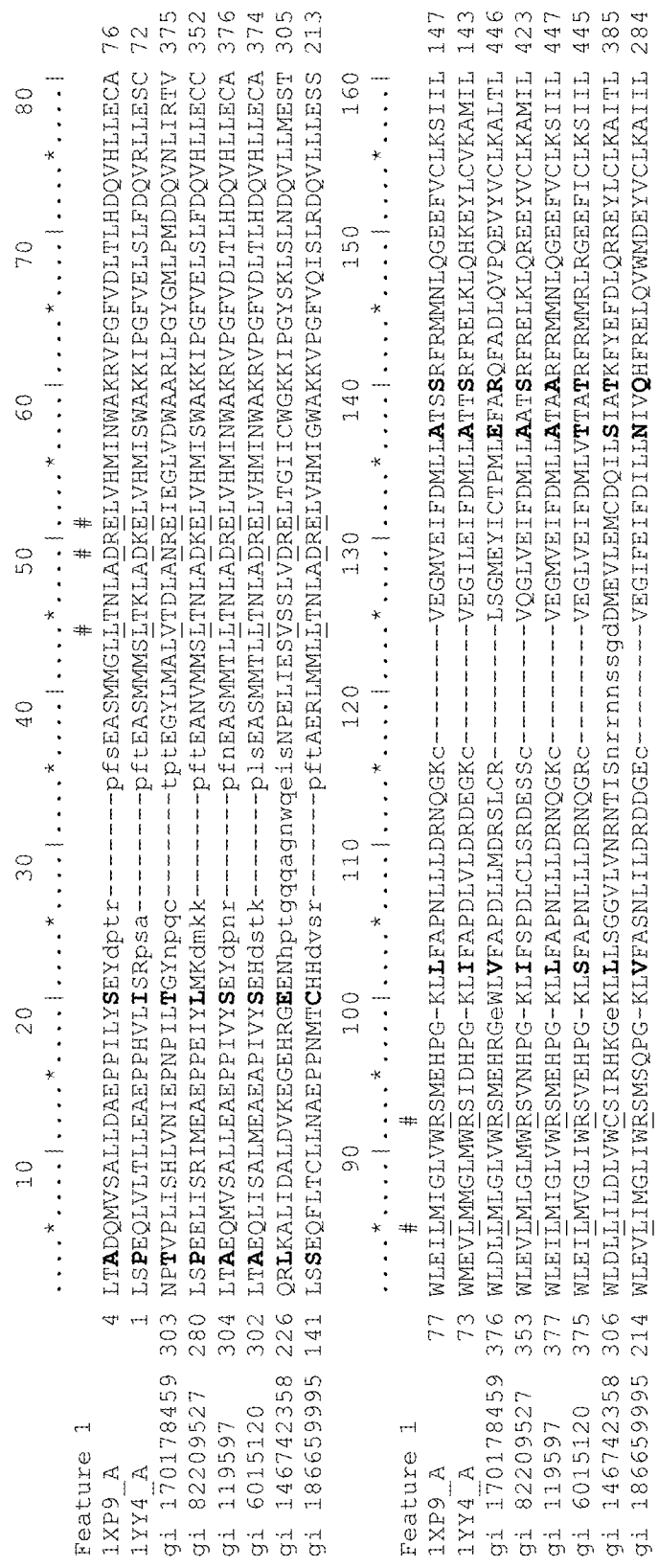

As one non-limiting example, the LBD of an ERα can comprise an amino acid sequence having at least 75%, at least 80%, at least 85%, at least 90%, at least 95%, at least 98%, at least 99%, or 100%, amino acid sequence identity to an amino acid sequence depicted in FIG. 5H; and has a length of from about 200 amino acids to 240 amino acids (e.g., has a length of from 200 amino acids to 225 amino acids, from 225 amino acids to 230 amino acids, from 230 amino acids to 235 amino acids, or from 235 amino acids to 240 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5B; and has a length of from about 180 amino acids to 229 amino acids (e.g., has a length of from 180 amino acids to 200 amino acids, or from 200 amino acids to 229 amino acids; e.g., has a length of 229 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5C; and has a length of from about 250 amino acids to 314 amino acids (e.g., has a length of from 250 amino acids to 275 amino acids, from 275 amino acids to 300 amino acids, or from 300 amino acids to 314 amino acids; e.g., has a length of 314 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5D; and has a length of from about 190 amino acids to 238 amino acids (e.g., has a length of from 190 amino acids to 220 amino acids, or from 220 amino acids to 238 amino acids; e.g., has a length of 238 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5E, and has a D351Y substitution (where the amino acid numbering is based on the amino acid sequence depicted in FIG. 5A); and has a length of from about 180 amino acids to 229 amino acids (e.g., has a length of from 180 amino acids to 200 amino acids, or from 200 amino acids to 229 amino acids; e.g., has a length of 229 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5F, and has a D351Y substitution (where the amino acid numbering is based on the amino acid sequence depicted in FIG. 5A); and has a length of from about 250 amino acids to 314 amino acids (e.g., has a length of from 250 amino acids to 275 amino acids, from 275 amino acids to 300 amino acids, or from 300 amino acids to 314 amino acids; e.g., has a length of 314 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5G, and has a D351Y substitution (where the amino acid numbering is based on the amino acid sequence depicted in FIG. 5A); and has a length of from about 190 amino acids to 238 amino acids (e.g., has a length of from 190 amino acids to 220 amino acids, or from 220 amino acids to 238 amino acids; e.g., has a length of 238 amino acids).

In some cases, where the first member of a dimerization pair of a conditionally active, heterodimeric polypeptide of the present disclosure is an LBD of an ERα, the second member of the dimerization pair is a co-regulator peptide comprising the amino acid sequence DAFQLRQLILR-GLQDD (SEQ ID NO:12), where the co-regulator peptide has a length of from about 16 amino acids to about 50 amino acids (e.g., the co-regulator peptide has a length of from 16 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERα, the first member of the dimerization pair is a co-regulator peptide comprising the amino acid sequence DAFQLRQLILRGLQDD (SEQ ID NO:12), where the co-regulator peptide has a length of from about from about 16 amino acids to about 50 amino acids (e.g., the co-regulator peptide has a length of from 16 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an ERα, the second member of the dimerization pair is a co-regulator peptide comprising the amino acid sequence SPGSREWFKDMLS (SEQ ID NO:13), where the co-regulator peptide has a length of from about 13 amino acids to about 50 amino acids (e.g., the co-regulator peptide has a length of from 13 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERα, the first member of the dimerization pair is a co-regulator peptide comprising the amino acid sequence SPGSREWFKDMLS (SEQ ID NO:13), where the co-regulator peptide has a length of from about 13 amino acids to about 50 amino acids (e.g., the co-regulator peptide has a length of from 13 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Estrogen Receptor-Beta (ERβ)

In some cases, an LBD suitable for inclusion as a member of a dimerization pair of a conditionally active, heterodimeric polypeptide of the present disclosure is an LBD of estrogen receptor-alpha (ERβ). For example, in some cases, the LBD comprises an amino acid sequence having at least 75%, at least 80%, at least 85%, at least 90%, at least 95%, at least 98%, at least 99%, or 100%, amino acid sequence identity to the LBD of an ERβ having the amino acid sequence depicted in FIG. 6A.

As one non-limiting example, the LBD of an ERβ can comprise an amino acid sequence having at least 75%, at least 80%, at least 85%, at least 90%, at least 95%, at least 98%, at least 99%, or 100%, amino acid sequence identity to an amino acid sequence depicted in FIG. 6C; and has a length of from about 200 amino acids to 243 amino acids (e.g., has a length of from 200 amino acids to 225 amino acids, from 225 amino acids to 230 amino acids, from 230 amino acids to 235 amino acids, or from 235 amino acids to 243 amino acids).

As one non-limiting example, the LBD of an ERβ can comprise an amino acid sequence having at least 75%, at least 80%, at least 85%, at least 90%, at least 95%, at least 98%, at least 99%, or 100%, amino acid sequence identity to the amino acid sequence depicted in FIG. 6B; and has a length of from about 200 amino acids to 243 amino acids (e.g., has a length of from 200 amino acids to 225 amino acids, from 225 amino acids to 230 amino acids, from 230 amino acids to 235 amino acids, or from 235 amino acids to 243 amino acids).

In some cases, where the first member of a dimerization pair of a conditionally active, heterodimeric polypeptide of the present disclosure is an LBD of an ERβ, the second member of the dimerization pair is a co-regulator peptide comprising the amino acid sequence PRQGSILYSMLT-SAKQT (SEQ ID NO:9), where the co-regulator peptide has a length of from about 17 amino acids to about 50 amino acids (e.g., the co-regulator peptide has a length of from 17 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERβ, the first member of the dimerization pair is a co-regulator peptide comprising the amino acid sequence PRQGSILYSMLTSAKQT (SEQ ID NO:9), where the co-regulator peptide has a length of from about from about 17 amino acids to about 50 amino acids (e.g., the co-regulator peptide has a length of from 17 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Peroxisome Proliferator-Activated Receptor-Gamma

In some cases, an LBD suitable for inclusion as a member of a dimerization pair of a conditionally active, heterodimeric polypeptide of the present disclosure is an LBD of peroxisome proliferator-activated receptor-gamma (PPAR-γ). For example, in some cases, the LBD comprises an amino acid sequence having at least 75%, at least 80%, at least 85%, at least 90%, at least 95%, at least 98%, at least 99%, or 100%, amino acid sequence identity to the LBD of a PPAR-γ having the amino acid sequence depicted in FIG. 7A.

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 7E; and has a length of from about 200 amino acids to 269 amino acids (e.g., has a length of from 200 amino acids to 225 amino acids, from 225 amino acids to 250 amino acids, or from 250 amino acids to 269 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7B; and has a length of from about 150 amino acids to 202 amino acids (e.g., has a length of from 150 amino acids to 160 amino acids, from 160 amino acids to 170 amino acids, from 170 amino acids to 190 amino acids, or from 190 amino acids to 202 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7C; and has a length of from about 200 amino acids to 269 amino acids (e.g., has a length of from 200 amino acids to 225 amino acids, from 225 amino acids to 250 amino acids, or from 250 amino acids to 269 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7D; and has a length of from about 200 amino acids to 269 amino acids (e.g., has a length of from 200 amino acids to 225 amino acids, from 225 amino acids to 250 amino acids, or from 250 amino acids to 271 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence CPSSHSSLTERH-KILHRLLQEGSPS (SEQ ID NO:1), where the co-regulator peptide has a length of from about 25 amino acids to about 50 amino acids (e.g., the co-regulator peptide has a length of from 25 amino acids to 28 amino acids, from 28 amino acids to 29 amino acids, from 29 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence CPSSHSSLTERH-KILHRLLQEGSPS (SEQ ID NO:1), where the co-regulator peptide has a length of from about from about 17 amino acids to about 50 amino acids (e.g., the co-regulator peptide has a length of from about 25 amino acids to about 50 amino acids (e.g., the co-regulator peptide has a length of from 25 amino acids to 28 amino acids, from 28 amino acids to 29 amino acids, from 29 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence PKKENNALLRYLL-DRDDPSDV (SEQ ID NO:4), where the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence PKKENNALLRYLLDRDDPSDV (SEQ ID NO:4), where the co-regulator peptide has a length of from about from about 17 amino acids to about 50 amino acids (e.g., the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence PKKKENALLRYLL-DKDDTKDI (SEQ ID NO:11), where the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence PKKKENALLRYLLDKDDTKDI (SEQ ID NO:11), where the co-regulator peptide has a length of from about from about 21 amino acids to about 50 amino acids (e.g., the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Glucocorticoid Receptor

In some cases, an LBD suitable for inclusion as a member of a dimerization pair of a conditionally active, heterodimeric polypeptide of the present disclosure is an LBD of glucocorticoid receptor (GR). For example, in some cases, the LBD comprises an amino acid sequence having at least 75%, at least 80%, at least 85%, at least 90%, at least 95%, at least 98%, at least 99%, or 100%, amino acid sequence identity to the LBD of a GR having the amino acid sequence depicted in FIG. 8A.

As one non-limiting example, the LBD of a GR can comprise an amino acid sequence having at least 75%, at least 80%, at least 85%, at least 90%, at least 95%, at least 98%, at least 99%, or 100%, amino acid sequence identity to one of the amino acid sequences depicted in FIG. 8C; and has a length of from about 200 amino acids to 247 amino acids (e.g., has a length of from 200 amino acids to 225 amino acids, from 225 amino acids to 230 amino acids, from 230 amino acids to 240 amino acids, or from 240 amino acids to 247 amino acids).

As one non-limiting example, the LBD of a GR can comprise an amino acid sequence having at least 75%, at least 80%, at least 85%, at least 90%, at least 95%, at least 98%, at least 99%, or 100%, amino acid sequence identity to the amino acid sequence depicted in FIG. 8B; and has a length of from about 200 amino acids to 247 amino acids (e.g., has a length of from 200 amino acids to 225 amino acids, or from 225 amino acids to 247 amino acids; e.g., has a length of 247 amino acids).

In some cases, where the first member of a dimerization pair of a conditionally active, heterodimeric polypeptide of the present disclosure is an LBD of a GR, the second member of the dimerization pair is an NCOA1/SRC1 polypeptide. For example, in some cases, where the first member of a dimerization pair of a conditionally active, heterodimeric polypeptide of the present disclosure is an LBD of a GR, the second member of the dimerization pair is an NCOA1/SRC1 polypeptide comprising the amino acid sequence NYGTNPGTPPASTSPFSQLAANPEA-SLANRN-SMVSRGMTGNIGGQFGTGINPQMQQNVFQYPG AGMVPQGEANFAPSL-SPGSSMVPMPIPPPQSSLLQQTP-PASGYQSPDMKAWQQGAIGNNNVFSQ AVQNQPT-PAQPGVYNNMSITVSMAGGNTNVQNMNPMMAQM-QMSSLQMPGMNTVCPEQIND PALRHTGLYCNQLSSTDLLK-TEADGTQQVQQVQVFAD-VQCTVNLVGGDPYLNQPGPLGTQKP TSGPQTPQAQQKSLLQQLLTE (SEQ ID NO:556) or a fragment thereof. In some cases, where the second member of a dimerization pair of a conditionally active, heterodimeric polypeptide of the present disclosure is an LBD of a GR, the first member of the dimerization pair is an NCOA1/SRC1 polypeptide.

In some cases, where the first member of a dimerization pair of a conditionally active, heterodimeric polypeptide of the present disclosure is an LBD of a GR, the second member of the dimerization pair is an NCOA2/SRC2 polypeptide. For example, in some cases, where the first member of a dimerization pair of a conditionally active, heterodimeric polypeptide of the present disclosure is an LBD of a GR, the second member of the dimerization pair is an NCOA2/SRC2 polypeptide comprising the amino acid sequence KRHHHEVLRQGLAFSQIYRFSLSDGTLVAAQTKSK-LIRSQTTNEPQLVISLHMLHREQNVCVMN PDLTGQTMGKPLNPISSNSPAHQAL-CSGNPGQDMTLSSN-INFPINGPKEQMGMPMGRFGGSGG MNHVSGMQAT-TPQGSNYALKMNSPSQSSPGMNPGQPTSMLSPRHR-MSPGVAGSPRIPPSQFSPA GSLHSPVGVCSSTGNSH-SYTNSSLNALQALSEGHGVSLGSSLASPDLKMGNL-QNSPVNMNPPPL SKMGSLDSKDCFGLY-GEPSEGTTGQAESSCHPGEQKETNDPNLPPAVSSE-RADGQSRLHDSKGQ TKLLQLLTTKSDQMEPSPLASSLSDTNKD-STGSLPGSGSTHGTSLKEKHKILHRLLQDSSSPVDL AKLTAEATGKDLSQESSSTAPGSEV-TIKQEPVSPKKKENALLRYLLDKDDTKDIGL-PEITPKLERL DSKTDPASNTKLIAMKTEKEEMS-FEPGDQPGSELDNLEEILDDLQNSQLPQLFPDTRPG-APAGSV DKQAIINDLMQLTAENSPVTPVGAQKTAL-RISQSTFNNPRPGQLGRLLPNQNLPLDITLQSPTGA GPFPPIRNSSPYSVIPQPGMMGNQG-MIGNQGNLGNSSTGMIGNSASRPTMPSGEWAPQS-SAVRV TCAATTSAMNRPVQGGMIRNPAA-SIPMRPSSQPGQRQTLQSQVMNIGPSELEMNMGGP (SEQ ID NO:557) or a fragment thereof. In some cases, where the second member of a dimerization pair of a conditionally active, heterodimeric polypeptide of the present disclosure is an LBD of a GR, the first member of the dimerization pair is an NCOA2/SRC2 polypeptide.

Vitamin D Receptor

In some cases, an LBD suitable for inclusion as a member of a dimerization pair of a conditionally active, heterodimeric polypeptide of the present disclosure is an LBD of vitamin D receptor (VDR). For example, in some cases, the LBD comprises an amino acid sequence having at least 75%, at least 80%, at least 85%, at least 90%, at least 95%, at least 98%, at least 99%, or 100%, amino acid sequence identity to the LBD of a VDR having the amino acid sequence depicted in FIG. 9A.

As one non-limiting example, the LBD of a VDR can comprise an amino acid sequence having at least 75%, at least 80%, at least 85%, at least 90%, at least 95%, at least 98%, at least 99%, or 100%, amino acid sequence identity to one of the amino acid sequences depicted in FIG. 9C; and has a length of from about 250 amino acids to 310 amino acids (e.g., has a length of from 250 amino acids to 275 amino acids, from 275 amino acids to 300 amino acids, or from 300 amino acids to 310 amino acids).

As one non-limiting example, the LBD of a VDR can comprise an amino acid sequence having at least 75%, at least 80%, at least 85%, at least 90%, at least 95%, at least 98%, at least 99%, or 100%, amino acid sequence identity to the amino acid sequence depicted in FIG. 9B; and has a length of from about 250 amino acids to 303 amino acids (e.g., has a length of from 250 amino acids to 275 amino acids, from 275 amino acids to 300 amino acids, or from 300 amino acids to 303 amino acids).

In some cases, where the first member of a dimerization pair of a conditionally active, heterodimeric polypeptide of the present disclosure is an LBD of a VDR, the second member of the dimerization pair is an NCOA1/SRC1 polypeptide. For example, in some cases, where the first member of a dimerization pair of a conditionally active, heterodimeric polypeptide of the present disclosure is an LBD of a VDR, the second member of the dimerization pair is an NCOA1/SRC1 polypeptide comprising the amino acid sequence NYGTNPGTPPASTSPFSQLAANPEA-SLANRN-SMVSRGMTGNIGGQFGTGINPQMQQNVFQYPG AGMVPQGEANFAPSL-SPGSSMVPMPIPPPQSSLLQQTP-PASGYQSPDMKAWQQGAIGNNNVFSQ AVQNQPT-PAQPGVYNNMSITVSMAGGNTNVQNMNPMMAQM-QMSSLQMPGMNTVCPEQIND PALRHTGLYCNQLSSTDLLK-TEADGTQQVQQVQVFAD-VQCTVNLVGGDPYLNQPGPLGTQKP TSGPQTPQAQQKSLLQQLLTE (SEQ ID NO:558) or a fragment thereof. In some cases, where the second member of a dimerization pair of a conditionally active, heterodimeric polypeptide of the present disclosure is an LBD of a VDR, the first member of the dimerization pair is an NCOA1/SRC1 polypeptide.

In some cases, where the first member of a dimerization pair of a conditionally active, heterodimeric polypeptide of the present disclosure is an LBD of a VDR, the second member of the dimerization pair is an NCOA2/SRC2 polypeptide. For example, in some cases, where the first member of a dimerization pair of a conditionally active, heterodimeric polypeptide of the present disclosure is an LBD of a VDR, the second member of the dimerization pair is an NCOA2/SRC2 polypeptide comprising the amino acid sequence KRHHHEVLRQGLAFSQIYRFSLSDGTLVAAQTKSK-LIRSQTTNEPQLVISLHMLHREQNVCVMN PDLTGQTMGKPLNPISSNSPAHQAL-CSGNPGQDMTLSSN-INFPINGPKEQMGMPMGRFGGSGG MNHVSGMQAT-TPQGSNYALKMNSPSQSSPGMNPGQPTSMLSPRHR-MSPGVAGSPRIPPSQFSPA GSLHSPVGVCSSTGNSH- SYTNSSLNALQALSEGHGVSLGSSLASPDLKMGNL-QNSPVNMNPPPL SKMGSLDSKDCFGLY-GEPSEGTTGQAESSCHPGEQKETNDPNLPPAVSSE-RADGQSRLHDSKGQ
TKLLQLLTTKSDQMEPSPLASSLSDTNKD-STGSLPGSGSTHGTSLKEKHKILHRLLQDSSSPVDL AKLTAEATGKDLSQESSSTAPGSEV-TIKQEPVSPKKKENALLRYLLDKDDTKDIGL-PEITPKLERL DSKTDPASNTKLIAMKTEKEEMS-FEPGDQPGSELDNLEEILDDLQNSQLPQLFPDTRPGA-PAGSV DKQAIINDLMQLTAENSPVTPVGAQKTAL-RISQSTFNNPRPGQLGRLLPNQNLPLDITLQSPTGA GPFPPIRNSSPYSVIPQPGMMGNQG-MIGNQGNLGNSSTGMIGNSASRPTMPSGEWAPQS-SAVRV TCAATTSAMNRPVQGGMIRNPAA-SIPMRPSSQPGQRQTLQSQVMNIGPSELEMNMGGP (SEQ ID NO:559) or a fragment thereof. For example, in some cases, where the first member of a dimerization pair of a conditionally active, heterodimeric polypeptide of the present disclosure is an LBD of a VDR, the second member of the dimerization pair is an NCOA2/SRC2 polypeptide comprising the amino acid sequence LLRYLLDK (SEQ ID NO:560), where the co-regulator peptide has a length of from about from about 8 amino acids to about 50 amino acids (e.g., the co-regulator peptide has a length of from about 8 amino acids to 10 amino acids, from 10 amino acids to 15 amino acids, from 15 amino acids to 20 amino acids, from 20 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a VDR, the first member of the dimerization pair is an NCOA2/SRC2 polypeptide.

Thyroid Hormone Receptor-Alpha

In some cases, an LBD suitable for inclusion as a member of a dimerization pair of a conditionally active, heterodimeric polypeptide of the present disclosure is an LBD of thyroid hormone receptor-alpha (TRα). For example, in some cases, the LBD comprises an amino acid sequence having at least 75%, at least 80%, at least 85%, at least 90%, at least 95%, at least 98%, at least 99%, or 100%, amino acid sequence identity to the LBD of a TRα having the amino acid sequence depicted in FIG. 10A.

As one non-limiting example, the LBD of a TRα can comprise an amino acid sequence having at least 75%, at least 80%, at least 85%, at least 90%, at least 95%, at least 98%, at least 99%, or 100%, amino acid sequence identity to one of the amino acid sequences depicted in FIG. 10C; and has a length of from about 190 amino acids to about 245 amino acids (e.g., has a length of from 190 amino acids to 210 amino acids, from 210 amino acids to 230 amino acids, or from 230 amino acids to 245 amino acids).

As one non-limiting example, the LBD of a TRα can comprise an amino acid sequence having at least 75%, at least 80%, at least 85%, at least 90%, at least 95%, at least 98%, at least 99%, or 100%, amino acid sequence identity to the amino acid sequence depicted in FIG. 10B; and has a length of from about 190 amino acids to about 243 amino acids (e.g., has a length of from 190 amino acids to 210 amino acids, from 210 amino acids to 230 amino acids, or from 230 amino acids to 243 amino acids).

A suitable co-regulator peptide for TRα is an SRC1 polypeptide, or a fragment thereof (e.g., a peptide of from 8 amino acids to 50 amino acids in length, derived from an SRC1 polypeptide).

Retinoic Acid Receptor-Beta

In some cases, an LBD suitable for inclusion as a member of a dimerization pair of a conditionally active, heterodimeric polypeptide of the present disclosure is an LBD of retinoic acid receptor-beta (RARβ). For example, in some cases, the LBD comprises an amino acid sequence having at least 75%, at least 80%, at least 85%, at least 90%, at least 95%, at least 98%, at least 99%, or 100%, amino acid sequence identity to the LBD of a RARβ having the amino acid sequence depicted in FIG. 11A.

As one non-limiting example, the LBD of a RARβ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 11C; and has a length of from about 180 amino acids to about 235 amino acids (e.g., has a length of from 180 amino acids to 200 amino acids, from 200 amino acids to 220 amino acids, or from 220 amino acids to 235 amino acids).

As one non-limiting example, the LBD of a RARβ can comprise an amino acid sequence having at least 75%, at least 80%, at least 85%, at least 90%, at least 95%, at least 98%, at least 99%, or 100%, amino acid sequence identity to the amino acid sequence depicted in FIG. 11B; and has a length of from about 180 amino acids to about 231 amino acids (e.g., has a length of from 180 amino acids to 200 amino acids, from 200 amino acids to 220 amino acids, or from 220 amino acids to 231 amino acids).

A suitable co-regulator peptide for RARβ is an SRC1 polypeptide, or a fragment thereof (e.g., a peptide of from 8 amino acids to 50 amino acids in length, derived from an SRC1 polypeptide).

In some cases, where the first member of a dimerization pair of a conditionally active, heterodimeric polypeptide of the present disclosure is an LBD of a RARβ, the second member of the dimerization pair is an NCOA1/SRC1 polypeptide. For example, in some cases, where the first member of a dimerization pair of a conditionally active, heterodimeric polypeptide of the present disclosure is an LBD of a RARβ, the second member of the dimerization pair is an NCOA1/SRC1 polypeptide comprising the amino acid sequence NYGTNPGTPPASTSPFSQLAANPEA-SLANRN-
SMVSRGMTGNIGGQFGTGINPQMQQNVFQYPG AGMVPQGEANFAPSL-
SPGSSMVPMPIPPPQSSLLQQTP-
PASGYQSPDMKAWQQGAIGNNNVFSQ AVQNQPT-PAQPGVYNNMSITVSMAGGNTNVQNMNPMMAQM-QMSSLQMPGMNTVCPEQIND
PALRHTGLYCNQLSSTDLLK-
TEADGTQQVQQVQVFAD-
VQCTVNLVGGDPYLNQPGPLGTQKP
TSGPQTPQAQQKSLLQQLLTE (SEQ ID NO:561) or a fragment thereof. In some cases, where the second member of a dimerization pair of a conditionally active, heterodimeric polypeptide of the present disclosure is an LBD of a RARβ, the first member of the dimerization pair is an NCOA1/SRC1 polypeptide.

In some cases, where the first member of a dimerization pair of a conditionally active, heterodimeric polypeptide of the present disclosure is an LBD of a RARβ, the second member of the dimerization pair is an NCOA2/SRC2 polypeptide. For example, in some cases, where the first member of a dimerization pair of a conditionally active, heterodimeric polypeptide of the present disclosure is an LBD of a RARβ, the second member of the dimerization pair is an NCOA2/SRC2 polypeptide comprising the amino acid sequence KRHHHEVLRQGLAFSQIYRFSLSDGTLVAAQTKSK-LIRSQTTNEPQLVISLHMLHREQNVCVMN PDLTGQTMGKPLNPISSNSPAHQAL-CSGNPGQDMTLSSN-INFPINGPKEQMGMPMGRFGGSGG MNHVSGMQAT-TPQGSNYALKMNSPSQSSPGMNPGQPTSMLSPRHR-MSPGVAGSPRIPPSQFSPA GSLHSPVGVCSSTGNSH-SYTNSSLNALQALSEGHGVSLGSSLASPDLKMGNL-QNSPVNMNPPPL SKMGSLDSKDCFGLY-GEPSEGTTGQAESSCHPGEQKETNDPNLPPAVSSE-RADGQSRLHDSKGQ TKLLQLLTTKSDQMEPSPLASSLSDTNKD-STGSLPGSGSTHGTSLKEKHKILHRLLQDSSSPVDL AKLTAEATGKDLSQESSSTAPGSEV-TIKQEPVSPKKKENALLRYLLDKDDTKDIGL-PEITPKLERL DSKTDPASNTKLIAMKTEKEEMS-FEPGDQPGSELDNLEEILDDLQNSQLPQLFPDTRPGA-PAGSV DKQAIINDLMQLTAENSPVTPVGAQKTAL-RISQSTFNNPRPGQLGRLLPNQNLPLDITLQSPTGA GPFPPIRNSSPYSVIPQPGMMGNQG-MIGNQGNLGNSSTGMIGNSASRPTMPSGEWAPQS-SAVRV TCAATTSAMNRPVQGGMIRNPAA-SIPMRPSSQPGQRQTLQSQVMNIGPSELEMNMGGP (SEQ ID NO:562) or a fragment thereof. In some cases, where the second member of a dimerization pair of a conditionally active, heterodimeric polypeptide of the present disclosure is an LBD of a RARβ, the first member of the dimerization pair is an NCOA2/SRC2 polypeptide.

Farnesoid X Receptor

In some cases, an LBD suitable for inclusion as a member of a dimerization pair of a conditionally active, heterodimeric polypeptide of the present disclosure is an LBD of farnesoid X receptor (FXR. For example, in some cases, the LBD comprises an amino acid sequence having at least 75%, at least 80%, at least 85%, at least 90%, at least 95%, at least 98%, at least 99%, or 100%, amino acid sequence identity to the LBD of an FXR having the amino acid sequence depicted in FIG. 22A.

As one non-limiting example, the LBD of an FXR can comprise an amino acid sequence having at least 75%, at least 80%, at least 85%, at least 90%, at least 95%, at least 98%, at least 99%, or 100%, amino acid sequence identity to the amino acid sequence depicted in FIG. 22B; and has a length of from about 100 amino acids to about 136 amino acids (e.g., has a length of from 100 amino acids to 110 amino acids, from 110 amino acids to 120 amino acids, or from 120 amino acids to 136 amino acids).

A suitable co-regulator peptide for an FXR is an SRC1 polypeptide, or a fragment thereof (e.g., a peptide of from 8 amino acids to 50 amino acids in length, derived from an SRC1 polypeptide).

LXR-Alpha

In some cases, an LBD suitable for inclusion as a member of a dimerization pair of a conditionally active, heterodimeric polypeptide of the present disclosure is an LBD of liver X receptor-alpha (LRXα). For example, in some cases, the LBD comprises an amino acid sequence having at least 75%, at least 80%, at least 85%, at least 90%, at least 95%, at least 98%, at least 99%, or 100%, amino acid sequence identity to the LBD of an LRXα having the amino acid sequence depicted in FIG. 23A.

As one non-limiting example, the LBD of an LRXα can comprise an amino acid sequence having at least 75%, at least 80%, at least 85%, at least 90%, at least 95%, at least 98%, at least 99%, or 100%, amino acid sequence identity to the amino acid sequence depicted in FIG. 23B; and has a length of from about 200 amino acids to about 266 amino acids (e.g., has a length of from 200 amino acids to 220 amino acids, from 220 amino acids to 240 amino acids, or from 240 amino acids to 266 amino acids).

A suitable co-regulator peptide for an LRXα is an SRC1 polypeptide, or a fragment thereof (e.g., a peptide of from 8 amino acids to 50 amino acids in length, derived from an SRC1 polypeptide).

RORgamma

In some cases, an LBD suitable for inclusion as a member of a dimerization pair of a conditionally active, heterodimeric polypeptide of the present disclosure is an LBD of a retinoid-related orphan receptor gamma (RORγ). For example, in some cases, the LBD comprises an amino acid sequence having at least 75%, at least 80%, at least 85%, at least 90%, at least 95%, at least 98%, at least 99%, or 100%, amino acid sequence identity to the LBD of an RORγ having the amino acid sequence depicted in FIG. 24A.

As one non-limiting example, the LBD of an RORγ can comprise an amino acid sequence having at least 75%, at least 80%, at least 85%, at least 90%, at least 95%, at least 98%, at least 99%, or 100%, amino acid sequence identity to the amino acid sequence depicted in FIG. 24B; and has a length of from about 200 amino acids to about 261 amino acids (e.g., has a length of from 200 amino acids to 220 amino acids, from 220 amino acids to 240 amino acids, or from 240 amino acids to 261 amino acids).

A suitable co-regulator for an RORγ is an NCORNR peptide (CDPASNLGLEDIIRKALMGSFDDK, SEQ ID NO:563).

A suitable co-regulator peptide for an RORγ is an SRC1 polypeptide, or a fragment thereof (e.g., a peptide of from 8 amino acids to 50 amino acids in length, derived from an SRC1 polypeptide).

RXR-Alpha

In some cases, an LBD suitable for inclusion as a member of a dimerization pair of a conditionally active, heterodimeric polypeptide of the present disclosure is an LBD of a retinoid-X receptor-alpha (RXRα). For example, in some cases, the LBD comprises an amino acid sequence having at least 75%, at least 80%, at least 85%, at least 90%, at least 95%, at least 98%, at least 99%, or 100%, amino acid sequence identity to the LBD of an RXRα having the amino acid sequence depicted in FIG. 25A.

As one non-limiting example, the LBD of an RORγ can comprise an amino acid sequence having at least 75%, at least 80%, at least 85%, at least 90%, at least 95%, at least 98%, at least 99%, or 100%, amino acid sequence identity to the amino acid sequence depicted in FIG. 25B; and has a length of from about 190 amino acids to about 238 amino acids (e.g., has a length of from 190 amino acids to 200 amino acids, from 200 amino acids to 210 amino acids, or from 210 amino acids to 238 amino acids).

A suitable co-regulator peptide for an RXRα is an SRC1 polypeptide, or a fragment thereof (e.g., a peptide of from 8 amino acids to 50 amino acids in length, derived from an SRC1 polypeptide).

PXR

In some cases, an LBD suitable for inclusion as a member of a dimerization pair of a conditionally active, heterodimeric polypeptide of the present disclosure is an LBD of a Pregnane X Receptor (PXR). For example, in some cases, the LBD comprises an amino acid sequence having at least 75%, at least 80%, at least 85%, at least 90%, at least 95%, at least 98%, at least 99%, or 100%, amino acid sequence identity to the LBD of a PXR having the amino acid sequence depicted in FIG. 26A. In some cases, the LBD comprises an amino acid sequence having at least 75%, at least 80%, at least 85%, at least 90%, at least 95%, at least 98%, at least 99%, or 100%, amino acid sequence identity to amino acids 143-428 of the amino acid sequence depicted in FIG. 26A. In some cases, the LBD comprises an amino acid sequence having at least 75%, at least 80%, at least 85%, at least 90%, at least 95%, at least 98%, at least 99%, or 100%, amino acid sequence identity to amino acids 205-434 of the amino acid sequence depicted in FIG. 26A.

As one non-limiting example, the LBD of a PXR can comprise an amino acid sequence having at least 75%, at least 80%, at least 85%, at least 90%, at least 95%, at least 98%, at least 99%, or 100%, amino acid sequence identity to the amino acid sequence depicted in FIG. 26B; and has a length of from about 250 amino acids to about 302 amino acids (e.g., has a length of from 250 amino acids to 275 amino acids, from 275 amino acids to 290 amino acids, or from 290 amino acids to 302 amino acids).

A suitable co-regulator peptide for a PXR is an SRC1 polypeptide, or a fragment thereof (e.g., a peptide of from 8 amino acids to 50 amino acids in length, derived from an SRC1 polypeptide).

Co-Regulator Polypeptides

Suitable co-regulator polypeptides include full-length naturally-occurring nuclear hormone co-regulator polypeptides. Suitable co-regulator polypeptides include fragments of naturally-occurring nuclear hormone co-regulator polypeptides. Suitable co-regulator polypeptides include synthetic or recombinant nuclear hormone co-regulator polypeptides.

Suitable co-regulator polypeptides can have a length of from 8 amino acids to 2000 amino acids. Suitable co-regulator polypeptides can have a length of from 8 amino acids to 50 amino acids, e.g., from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids. Suitable co-regulator polypeptides can have a length of from 50 amino acids to 100 amino acids, e.g., from 50 amino acids to 60 amino acids, from 60 amino acids to 70 amino acids, from 70 amino acids to 80 amino acids, from 80 amino acids to 90 amino acids, or from 90 amino acids to 100 amino acids. Suitable co-regulator polypeptides can have a length of from 100 amino acids to 200 amino acids, from 200 amino acids to 300 amino acids, from 300 amino acids to 400 amino acids, from 400 amino acids to 500 amino acids, from 500 amino acids to 600 amino acids, from 600 amino acids to 700 amino acids, from 700 amino acids to 800 amino acids, from 800 amino acids to 900 amino acids, or from 900 amino acids to 1000 amino acids. Suitable co-regulator polypeptides can have a length of from 1000 amino acids to 2000 amino acids.

Suitable co-regulator polypeptides include, but are not limited to, SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

National Center for Biotechnology Information (NCBI) accession numbers for such co-regulators include the following: SRC1 (NP_003734), GRIP1 (NP_006531), AIB1 (NP_006525), PGC1a (NP_037393), PGC1b (NP_573570), PRC (NP_055877), TRAP220 (NP_004765), ASC2 (NP_054790), CBP (NP_004371), P300 (NP_001420), CIA (NP_066018), ARA70 (NP_005428), TIF1 (NP_003843), NSD1 (NP_071900), SMAP (NP_006687), Tip60 (NP_006379), ERAP140 (NP_861447), Nix1 (NP_113662), LCoR (NP_115816), N-CoR (NP_006302), SMRT (NP_006303), RIP140 (NP_003480) and PRIC285 (NP_208384).

Examples of suitable co-regulator polypeptides are provided in FIGS. 29-51B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 29.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 30.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 31.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 32.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 33.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 34.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 35.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 36A-36B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 37A-37B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 36A-36B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 39.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 40.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 41.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 42A-42B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 43.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 44.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 45.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 46.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 47.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 48A-48B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 49A-49B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 50.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 51A-51B.

Suitable co-regulator peptides include, but are not limited to, Steroid Receptor Coactivator (SRC)-1, SRC-2, SRC-3, TRAP220-1, TRAP220-2, NR0B1, NRIP1, CoRNR box, αβV, TIF1, TIF2, EA2, TA1, EAB1, SRC1-1, SRC1-2, SRC1-3, SRC1-4a, SRC1-4b, GRIP1-1, GRIP1-2, GRIP1-3, AIB1-1, AIB1-2, AIB1-3, PGC1a, PGC1b, PRC, ASC2-1, ASC2-2, CBP-1, CBP-2, P300, CIA, ARA70-1, ARA70-2, NSD1, SMAP, Tip60, ERAP140, Nix1, LCoR, CoRNR1 (N-CoR), CoRNR2, SMRT, RIP140-C, RIP140-1, RIP140-2, RIP140-3, RIP140-4, RIP140-5, RIP140-6, RIP140-7, RIP140-8, RIP140-9, PRIC285-1, PRIC285-2, PRIC285-3, PRIC285-4, and PRIC285-5.

In some cases, a suitable co-regulator peptide comprises an LXXLL motif, where X is any amino acid; where the co-regulator peptide has a length of from 8 amino acids to 50 amino acids, e.g., from 8 amino acids to 10 amino acids, from 10 amino acids to 12 amino acids, from 12 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids.

Non-limiting examples of suitable co-regulator peptides are as follows:

```
SRC1:
                                   (SEQ ID NO: 1)
CPSSHSSLTERHKILHRLLQEGSPS;

SRC1-2:
                                   (SEQ ID NO: 2)
SLTARHKILHRLLQEGSPSDI;

SRC3-1:
                                   (SEQ ID NO: 3)
ESKGHKKLLQLLTCSSDDR;

SRC3:
                                   (SEQ ID NO: 4)
PKKENNALLRYLLDRDDPSDV;

PGC-1:
                                   (SEQ ID NO: 5)
AEEPSLLKKLLLAPANT;

PGC1a:
                                   (SEQ ID NO: 6)
QEAEEPSLLKKLLLAPANTQL;
```

-continued

TRAP220-1:
(SEQ ID NO: 7)
SKVSQNPILTSLLQITGNGGS;

NCoR (2051-2075):
(SEQ ID NO: 8)
GHSFADPASNLGLEDIIRKALMGSF;

NR0B1:
(SEQ ID NO: 9)
PRQGSILYSMLTSAKQT;

NRIP1:
(SEQ ID NO: 10)
AANNSLLLHLLKSQTIP;

TIF2:
(SEQ ID NO: 11)
PKKKENALLRYLLDKDDTKDI;

CoRNR Box:
(SEQ ID NO: 12)
DAFQLRQLILRGLQDD;

abV:
(SEQ ID NO: 13)
SPGSREWFKDMLS;

TRAP220-2:
(SEQ ID NO: 14)
GNTKNHPMLMNLLKDNPAQDF;

EA2:
(SEQ ID NO: 15)
SSKGVLWRMLAEPVSR;

TA1:
(SEQ ID NO: 16)
SRTLQLDWGTLYWSR;

EAB1:
(SEQ ID NO: 17)
SSNHQSSRLIELLSR;

SRC2:
(SEQ ID NO: 18)
LKEKHKILHRLLQDSSSPV;

SRC1-3:
(SEQ ID NO: 19)
QAQQKSLLQQLLTE;

SRC1-1:
(SEQ ID NO: 20)
KYSQTSHKLVQLLTTTAEQQL;

SRC1-2:
(SEQ ID NO: 21)
SLTARHKILHRLLQEGSPSDI;

SRC1-3:
(SEQ ID NO: 22)
KESKDHQLLRYLLDKDEKDLR;

SRC1-4a:
(SEQ ID NO: 23)
PQAQQKSLLQQLLTE;

SRC1-4b:
(SEQ ID NO: 24)
PQAQQKSLRQQLLTE;

GRIP1-1:
(SEQ ID NO: 25)
HDSKGQTKLLQLLTTKSDQME;

GRIP1-2:
(SEQ ID NO: 26)
SLKEKHKILHRLLQDSSSPVD;

GRIP1-3:
(SEQ ID NO: 27)
PKKKENALLRYLLDKDDTKDI;

AIB1-1:
(SEQ ID NO: 28)
LESKGHKKLLQLLTCSSDDRG;

AIB1-2:
(SEQ ID NO: 29)
LLQEKHRILHKLLQNGNSPAE;

AIB1-3:
(SEQ ID NO: 30)
KKKENNALLRYLLDRDDPSDA;

PGC1a:
(SEQ ID NO: 31)
QEAEEPSLLKKLLLAPANTQL;

PGC1b:
(SEQ ID NO: 32)
PEVDELSLLQKLLLATSYPTS;

PRC:
(SEQ ID NO: 33)
VSPREGSSLHKLLTLSRTPPE;

TRAP220-1:
(SEQ ID NO: 34)
SKVSQNPILTSLLQITGNGGS;

TRAP220-2:
(SEQ ID NO: 35)
GNTKNHPMLMNLLKDNPAQDF;

ASC2-1:
(SEQ ID NO: 36)
DVTLTSPLLVNLLQSDISAGH;

ASC2-2:
(SEQ ID NO: 37)
AMREAPTSLSQLLDNSGAPNV;

CBP-1:
(SEQ ID NO: 38)
DAASKHKQLSELLRGGSGSSI;

CBP-2:
(SEQ ID NO: 39)
KRKLIQQQLVLLLHAHKCQRR;

P300:
(SEQ ID NO: 40)
DAASKHKQLSELLRSGSSPNL;

CIA:
(SEQ ID NO: 41)
GHPPAIQSLINLLADNRYLTA;

ARA70-1:
(SEQ ID NO: 42)
TLQQQAQQLYSLLGQFNCLTH;

ARA70-2:
(SEQ ID NO: 43)
GSRETSEKFKLLFQSYNVNDW;

TIF1:
(SEQ ID NO: 44)
NANYPRSILTSLLLNSSQSST;

NSD1:
(SEQ ID NO: 45)
IPIEPDYKFSTLLMMLKDMHD;

SMAP:
(SEQ ID NO: 46)
ATPPPSPLLSELLKKGSLLPT;

```
Tip60:
                                        (SEQ ID NO: 47)
VDGHERAMLKRLLRIDSKCLH;

ERAP140:
                                        (SEQ ID NO: 48)
HEDLDKVKLIEYYLTKNKEGP;

Nix1:
                                        (SEQ ID NO: 49)
ESPEFCLGLQTLLSLKCCIDL;

LCoR:
                                        (SEQ ID NO: 50)
AATTQNPVLSKLLMADQDSPL;

CoRNR1 (N-CoR):
                                        (SEQ ID NO: 51)
MGQVPRTHRLITLADHICQIITQDFARNQV;

CoRNR2 (N-CoR):
                                        (SEQ ID NO: 52)
NLGLEDIIRKALMG;

CoRNR1 (SMRT):
                                        (SEQ ID NO: 53)
APGVKGHQRVVTLAQHISEVITQDTYRHHPQQLSAPLPAP;

CoRNR2 (SMRT):
                                        (SEQ ID NO: 54)
NMGLEAIIRKALMG;

RIP140-C:
                                        (SEQ ID NO: 55)
RLTKTNPILYYMLQKGGNSVA;

RIP140-1:
                                        (SEQ ID NO: 56)
QDSIVLTYLEGLLMHQAAGGS;

RIP140-2:
                                        (SEQ ID NO: 57)
KGKQDSTLLASLLQSFSSRLQ;

RIP140-3:
                                        (SEQ ID NO: 58)
CYGVASSHLKTLLKKSKVKDQ;

RIP140-4:
                                        (SEQ ID NO: 59)
KPSVACSQLALLLSSEAHLQQ;

RIP140-5:
                                        (SEQ ID NO: 60)
KQAANNSLLLHLLKSQTIPKP;

RIP140-6:
                                        (SEQ ID NO: 61)
NSHQKVTLLQLLLGHKNEENV;

RIP140-7:
                                        (SEQ ID NO: 62)
NLLERRTVLQLLLGNPTKGRV;

RIP140-8:
                                        (SEQ ID NO: 63)
FSFSKNGLLSRLLRQNQDSYL;

RIP140-9:
                                        (SEQ ID NO: 64)
RESKSFNVLKQLLLSENCVRD;

PRIC285-1:
                                        (SEQ ID NO: 65)
ELNADDAILRELLDESQKVMV;

PRIC285-2:
                                        (SEQ ID NO: 66)
YENLPPAALRKLLRAEPERYR;

PRIC285-3:
                                        (SEQ ID NO: 67)
MAFAGDEVLVQLLSGDKAPEG;

PRIC285-4:
                                        (SEQ ID NO: 68)
SCCYLCIRLEGLLAPTASPRP;
and PRIC285-5:
                                        (SEQ ID NO: 69)
PSNKSVDVLAGLLLRRMELKP.
```

Further examples are provided in Example 1, Example 2 and Example 3.

In some cases, a given LBD can be paired with two or more different co-regulator polypeptides. For example, as depicted in FIG. 19, PPARγ can be paired with SRC1, SRC2, SRC3, or TRAP220. As another example, ERα can be paired with CoRNR, αβV, or TA1. As another example, ERβ can be paired with CoRNR, αβV, or TA1. As another example, AR can be paired with SRC1, SRC2, SRC3, or TRAP220. As another example, PR can be paired with SRC1, SRC2, SRC3, TRAP220, NR0B1, PGC1B, NRIP1, EA2, or EAB1. As another example, TRβ can be paired with SRC1, SRC2, SRC3, or TRAP220.

In some cases, a heterodimeric polypeptide of the present disclosure comprises a polypeptide chain comprising multiple (two or more) co-regulator peptides. Where a heterodimeric polypeptide of the present disclosure comprises a polypeptide chain comprising multiple (two or more) co-regulator peptides, the multiple co-regulator peptides can be in tandem, directly or separated by a linker. In some cases, the two or more co-regulator peptides present in the polypeptide chain are identical in amino acid sequence to one another. In some cases, where a heterodimeric polypeptide of the present disclosure comprises a polypeptide chain comprising multiple (two or more) co-regulator peptides, the polypeptide chain comprises two co-regulator peptides. In some cases, where a heterodimeric polypeptide of the present disclosure comprises a polypeptide chain comprising multiple (two or more) co-regulator peptides, the polypeptide chain comprises three co-regulator peptides. In such cases, the second polypeptide chain can comprise multiple (two or more) LBD of a nuclear hormone receptor. For example, where the second polypeptide chain comprises two LBD of a nuclear hormone receptor, the two LBD can be identical in amino acid sequence to one another.

Intracellular Signaling Domain

Intracellular signaling domains suitable for use in a conditionally active heterodimeric polypeptide of the present disclosure include any desired signaling domain that provides a distinct and detectable signal (e.g., increased production of one or more cytokines by the cell; change in transcription of a target gene; change in activity of a protein; change in cell behavior, e.g., cell death; cellular proliferation; cellular differentiation; cell survival; modulation of cellular signaling responses; etc.) in response to activation of the conditionally active heterodimeric polypeptide (i.e., activated by antigen and dimerizing agent). In some instances, the intracellular signaling domain(s) of a conditionally active heterodimeric polypeptide of the present disclosure provides a signal transduction function when activated and may thus, in some instances, be referred to as a signal transducing domain. In some embodiments, the intracellular signaling domain includes at least one (e.g., one, two, three, four, five, six, etc.) ITAM motifs as described below. In some embodiments, the intracellular signaling domain includes DAP10/CD28 type signaling chains. In some embodiments, the intracellular signaling domain is not covalently attached to the membrane bound conditionally active heterodimeric polypeptide, but is instead diffused in the cytoplasm.

ITAM

Intracellular signaling domains suitable for use in a conditionally active heterodimeric polypeptide of the present disclosure include immunoreceptor tyrosine-based activation motif (ITAM)-containing intracellular signaling polypeptides. An ITAM motif is $YX_1X_2L/I$, where $X_1$ and $X_2$ are independently any amino acid (SEQ ID NO:564). In some cases, the intracellular signaling domain of a subject CAR comprises 1, 2, 3, 4, or 5 ITAM motifs. In some cases, an ITAM motif is repeated twice in an intracellular signaling domain, where the first and second instances of the ITAM motif are separated from one another by 6 to 8 amino acids, e.g., $(YX_1X_2L/I)(X_3)_n(YX_1X_2L/I)$, where n is an integer from 6 to 8, and each of the 6-8 $X_3$ can be any amino acid (SEQ ID NO:565). In some cases, the intracellular signaling domain of a subject CAR comprises 3 ITAM motifs.

A suitable intracellular signaling domain can be an ITAM motif-containing portion that is derived from a polypeptide that contains an ITAM motif. For example, a suitable intracellular signaling domain can be an ITAM motif-containing domain from any ITAM motif-containing protein. Thus, a suitable intracellular signaling domain need not contain the entire sequence of the entire protein from which it is derived. Examples of suitable ITAM motif-containing polypeptides include, but are not limited to: DAP12; FCER1G (Fc epsilon receptor I gamma chain); CD3D (CD3 delta); CD3E (CD3 epsilon); CD3G (CD3 gamma); CD3Z (CD3 zeta); and CD79A (antigen receptor complex-associated protein alpha chain).

In some cases, the intracellular signaling domain is derived from DAP12 (also known as TYROBP; TYRO protein tyrosine kinase binding protein; KARAP; PLOSL; DNAX-activation protein 12; KAR-associated protein; TYRO protein tyrosine kinase-binding protein; killer activating receptor associated protein; killer-activating receptor-associated protein; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to any of the following amino acid sequences (4 isoforms): MGGLEPCSRLLLLPLLLAVSGLRPVQAQAQSDCSCSTVSPGVLAGIVMGDLVLTVLIALAVYFL GRLVPRGRGAAEAATRKQRITETESPYQELQGQRSDVYSDLNTQRPYYK (SEQ ID NO:566); MGGLEPCSRLLLLPLLLAVSGLRPVQAQAQSDCSCSTVSPGVLAGIVMGDLVLTVLIALAVYFL GRLVPRGRGAAEATRKQRITETESPYQELQGQRSDVYSDLNTQRPYYK (SEQ ID NO:567); MGGLEPCSRLLLLPLLLAVSDCSCSTVSPGVLAGIVMGDLVLTVLIALAVYFLGRLVPRGRGAA EAATRKQRITETESPYQELQGQRSDVYSDLNTQRPYYK (SEQ ID NO:568); or MGGLEPCSRLLLLPLLLAVSDCSCSTVSPGVLAGIVMGDLVLTVLIALAVYFLGRLVPRGRGAA EATRKQRITETESPYQELQGQRSDVYSDLNTQRPYYK (SEQ ID NO:569), where the ITAM motifs are in bold and are underlined.

Likewise, a suitable intracellular signaling domain polypeptide can comprise an ITAM motif-containing portion of the full length DAP12 amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: ESPYQELQGQRSDVYSDLNTQ (SEQ ID NO:570), where the ITAM motifs are in bold and are underlined.

In some cases, the intracellular signaling domain is derived from FCER1G (also known as FCRG; Fc epsilon receptor I gamma chain; Fc receptor gamma-chain; fc-epsilon RI-gamma; fcRgamma; fceRI gamma; high affinity immunoglobulin epsilon receptor subunit gamma; immunoglobulin E receptor, high affinity, gamma chain; etc.). For example, a suitable intracellular signaling domain polypeptide can comprise an amino acid sequence having at least about 75%, at least about 80%, at least about 85%, at least about 90%, at least about 95%, at least about 98%, or 100% amino acid sequence identity to the following amino acid sequence: MIPAVVLLLLLLVEQAAALGEPQLCYILDAILFLYGIVLTLLYCRLKIQVRKAAITSYEKSDGV YTGLSTRNQETYETLKHEKPPQ (SEQ ID NO:571), where the ITAM motifs are in bold and are underlined.

Likewise, a suitable intracellular signaling domain polypeptide can comprise an ITAM motif-containing portion of the full length FCER1G amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DGVYTGLSTRNQETYETLKHE (SEQ ID NO:572), where the ITAM motifs are in bold and are underlined.

In some cases, the intracellular signaling domain is derived from T-cell surface glycoprotein CD3 delta chain (also known as CD3D; CD3-DELTA; T3D; CD3 antigen, delta subunit; CD3 delta; CD3d antigen, delta polypeptide (TiT3 complex); OKT3, delta chain; T-cell receptor T3 delta chain; T-cell surface glycoprotein CD3 delta chain; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 170 aa, of either of the following amino acid sequences (2 isoforms): MEHSTFLSGLVLATLLSQVSPFKIPIEELEDRVFVNCNTSITWVEGTVGTLLSDITRLDLGKRILDP RGIYRCNGTDIYKDKESTVQVHYRMCQSCVELDPATVAGIIVTDVIATLLLALGVFCFAGHETG RLSGAADTQALLRNDQVYQPLRDRDDAQYSHLGGNWARNK (SEQ ID NO:573) or MEHSTFLSGLVLATLLSQVSPFKIPIEELEDRVFVNCNTSITWVEGTVGTLLSDITRLDLGKRILDP RGIYRCNGTDIYKDKESTVQVHYRTADTQALLRNDQVYQPLRDRDDAQYSHLGGNWARNK (SEQ ID NO:574), where the ITAM motifs are in bold and are underlined.

Likewise, a suitable intracellular signaling domain polypeptide can comprise an ITAM motif-containing portion of the full length CD3 delta amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DQVYQPLRDRDDAQYSHLGGN (SEQ ID NO:575), where the ITAM motifs are in bold and are underlined.

In some cases, the intracellular signaling domain is derived from T-cell surface glycoprotein CD3 epsilon chain (also known as CD3e, T-cell surface antigen T3/Leu-4 epsilon chain, T-cell surface glycoprotein CD3 epsilon chain, AI504783, CD3, CD3epsilon, T3e, etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 205 aa, of the following amino acid sequence: MQSGTHWRVLGLCLLSVGVWGQDGNEEMGGITQTPYKVSISGTTVILTCPQYPGSEILWQHND KNIGGDEDDKNIGSDEDHLSLKEFSELEQSGYYVCYPRGSKPEDANFYLYLRARVCENCMEMD VMSVATIVIVDICITGGLLLLVYYWSKNRKAKAKPVTRGAGAGGRQRGQNKERPPPVPNPDYEPIRKGQRDLYSGLNQRRI (SEQ ID NO:576), where the ITAM motifs are in bold and are underlined.

Likewise, a suitable intracellular signaling domain polypeptide can comprise an ITAM motif-containing portion of the full length CD3 epsilon amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: NPDYEPIRKGQRDLYSGLNQR (SEQ ID NO:577), where the ITAM motifs are in bold and are underlined.

In some cases, the intracellular signaling domain is derived from T-cell surface glycoprotein CD3 gamma chain (also known as CD3G, T-cell receptor T3 gamma chain, CD3-GAMMA, T3G, gamma polypeptide (TiT3 complex), etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 180 aa, of the following amino acid sequence: MEQGKGLAVLILAIILLQGTLAQSIKGNHLVKVYDYQEDGSVLLTCDAEAKNITWFKDGKMIGF LTEDKKKWNLGSNAKDPRGMYQCKGSQNKSKPLQVYYRMCQNCIELNAATISGFLFAEIVSIFV LAVGVYFIAGQDGVRQSRASDKQTLLPNDQLYQPLKDREDDQYSHLQGNQLRRN (SEQ ID NO:578), where the ITAM motifs are in bold and are underlined.

Likewise, a suitable intracellular signaling domain polypeptide can comprise an ITAM motif-containing portion of the full length CD3 gamma amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: DQLYQPLKDREDDQYSHLQGN (SEQ ID NO:579), where the ITAM motifs are in bold and are underlined.

In some cases, the intracellular signaling domain is derived from T-cell surface glycoprotein CD3 zeta chain (also known as CD3Z, T-cell receptor T3 zeta chain, CD247, CD3-ZETA, CD3H, CD3Q, T3Z, TCRZ, etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 160 aa, of either of the following amino acid sequences (2 isoforms): MKWKALFTAAILQAQLPITEAQSFGLLDPKLCYLLDGILFIYGVILTALFLRVKFSRSADAPAYQ QGQNQLYNELNLGRREE YDVLDKRRGRDPEMGGKPRRKNPQEGL YNELQKDKMAEAYSEIG MKGERRRGKGHDGL YQGLSTATKDTYDALHMQALPPR (SEQ ID NO:580) or MKWKALFTAAILQAQLPITEAQSFGLLDPKLCYLLDGILFIYGVILTALFLRVKFSRSADAPAYQ QGQNQL YNELNLGRREE YDVLDKRRGRDPEMGGKPQRRKNPQEGL YNELQKDKMAEAYSEI GMKGERRRGKGHDGL YQGLSTATKDTYDALHMQALPPR(SEQ ID NO:581), where the ITAM motifs are in bold and are underlined.

Likewise, a suitable intracellular signaling domain polypeptide can comprise an ITAM motif-containing portion of the full length CD3 zeta amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to any of the following amino acid sequences: RVKFSRSADAPAYQQGQNQL YNELNLGRREE YDVLDKRRGRDPEMGGKPRRKNPQEGL YNELQKDKMAEAYSEIGMKGERRRGKGHDGL YQGLSTATKDTYDALHMQALPPR (SEQ ID NO:582); NQLYNELNLGRREEYDVLDKR (SEQ ID NO:583); EGLYNELQKDKMAEAYSEIGMK (SEQ ID NO:534); or DGLYQGLSTATKDTYDALHMQ (SEQ ID NO:585), where the ITAM motifs are in bold and are underlined.

In some cases, the intracellular signaling domain is derived from CD79A (also known as B-cell antigen receptor complex-associated protein alpha chain; CD79a antigen (immunoglobulin-associated alpha); MB-1 membrane glycoprotein; ig-alpha; membrane-bound immunoglobulin-associated protein; surface IgM-associated protein; etc.). For example, a suitable intracellular signaling domain polypeptide can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 150 aa, from about 150 aa to about 200 aa, or from about 200 aa to about 220 aa, of either of the following amino acid sequences (2 isoforms): MPGGPGVLQALPATIFLLFLLSAVYLGPGCQALWMHKVPASLMVSLGEDAHFQCPHNSSN NANVTWWRVLHGNYTWPPEFLGPGEDPNGTLIIQNVNKSHGGIYVCRVQEGNESY- QQSCGTYL RVRQPPPRPFLDMGEGTKNRIITAE-GIILLFCAVVPGTLLL-FRKRWQNEKLGLDAGDEYEDENLYEGLNLDDCSMYEDISRGLQGTYQDVGSLNIGDVQLEKP (SEQ ID NO:586); or MPGGPGVLQALPATIFLLFLL-SAVYLGPGCQALWMHKVPASLMVSLGE-DAHFQCPHNSSN NANVTWWRVLHGNYTWPPE-FLGPGEDPNEPPPRPFLDMGEGTKNRIITAEGIILLFC-AVVPGTLL LFRKRWQNEKLGLDAGDEYEDENLY-EGLNLDDCSMYEDISR-GLQGTYQDVGSLNIGDVQLEKP (SEQ ID NO:587), where the ITAM motifs are in bold and are underlined.

Likewise, a suitable intracellular signaling domain polypeptide can comprise an ITAM motif-containing portion of the full length CD79A amino acid sequence. Thus, a suitable intracellular signaling domain polypeptide can comprise an amino acid sequence having at least about 75%, at least about 80%, at least about 85%, at least about 90%, at least about 95%, at least about 98%, or 100%, amino acid sequence identity to the following amino acid sequence: ENLYEGLNLDDCSMYEDISRG (SEQ ID NO:588), where the ITAM motifs are in bold and are underlined.

DAP10/CD28

Intracellular signaling domains suitable for use in a conditionally active heterodimeric polypeptide of the present disclosure include a DAP10/CD28 type signaling chain.

An example of a DAP10 signaling chain is the amino acid sequence is: RPRRSPAQDGKVYINMPGRG (SEQ ID NO:589). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence RPRRSPAQDGKVYINMPGRG (SEQ ID NO:590).

An example of a CD28 signaling chain is the amino acid sequence is FWVLVVVGGVLACYSLLVTVAFIIFWVR-SKRSRLLHSDYMNMTPRRPGPTRKHYQPYAPPRDF AAYRS (SEQ ID NO:591). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence FWVLVVVGGVLACYSLL-VTVAFIIFWVRSKRSRLLHSDYMNMTPRRPGPTRKHYQPYAPPRDF AAYRS (SEQ ID NO:592).

ZAP70

Intracellular signaling domains suitable for use in a conditionally active heterodimeric polypeptide of the present disclosure include a ZAP70 polypeptide, e.g., a polypeptide comprising an amino acid sequence having at least about 85%, at least about 90%, at least about 95%, at least about 98%, at least about 99%, or 100%, amino acid sequence identity to a contiguous stretch of from about 300 amino acids to about 400 amino acids, from about 400 amino acids to about 500 amino acids, or from about 500 amino acids to 619 amino acids, of the following amino acid sequence:

```
                                    (SEQ ID NO: 593)
MPDPAAHLPFFYGSISRAEAEEHLKLAGMADGLFLLRQCLRSLGGYVLSL

VHDVRFHHFPIERQLNGTYAIAGGKAHCGPAELCEFYSRDPDGLPCNLRK

PCNRPSGLEPQPGVFDCLRDAMVRDYVRQTWKLEGEALEQAIISQAPQVE

KLIATTAHERMPWYHSSLTREEAERKLYSGAQTDGKFLLRPRKEQGTYAL

SLIYGKTVYHYLISQDKAGKYCIPEGTKFDTLWQLVEYLKLKADGLIYCL

KEACPNSSASNASGAAAPTLPAHPSTLTHPQRRIDTLNSDGYTPEPARIT

SPDKPRPMPMDTSVYESPYSDPEELKDKKLFLKRDNLLIADIELGCGNFG

SVRQGVYRMRKKQIDVAIKVLKQGTEKADTEEMMREAQIMHQLDNPYIVR

LIGVCQAEALMLVMEMAGGGPLHKFLVGKREEIPVSNVAELLHQVSMGMK

YLEEKNFVHRDLAARNVLLVNRHYAKISDFGLSKALGADDSYYTARSAGK

WPLKWYAPECINFRKFSSRSDVWSYGVTMWEALSYGQKPYKKMKGPEVMA

FIEQGKRMECPPECPPELYALMSDCWIYKWEDRPDFLTVEQRMRACYYSL

ASKVEGPPGSTQKAEAACA.
```

Additional Sequences

The first and/or the second polypeptide of a subject conditionally active heterodimeric polypeptide can further include one or more additional polypeptide domains, where such domains include, but are not limited to, a signal sequence; an epitope tag; an affinity domain; and a polypeptide that produces a detectable signal.

Signal Sequences

Signal sequences that are suitable for use in a subject CAR, e.g., in the first polypeptide of a subject CAR, include any eukaryotic signal sequence, including a naturally-occurring signal sequence, a synthetic (e.g., man-made) signal sequence, etc.

Epitope Tag

Suitable epitope tags include, but are not limited to, hemagglutinin (HA; e.g., YPYDVPDYA (SEQ ID NO:594); FLAG (e.g., DYKDDDDK (SEQ ID NO:595); c-myc (e.g., EQKLISEEDL; SEQ ID NO:596), and the like.

Affinity Domain

Affinity domains include peptide sequences that can interact with a binding partner, e.g., such as one immobilized on a solid support, useful for identification or purification. DNA sequences encoding multiple consecutive single amino acids, such as histidine, when fused to the expressed protein, may be used for one-step purification of the recombinant protein by high affinity binding to a resin column, such as nickel sepharose. Exemplary affinity domains include His5 (HHHHH) (SEQ ID NO:597), HisX6 (HHHHHH) (SEQ ID NO:598), C-myc (EQKLISEEDL) (SEQ ID NO:599), Flag (DYKDDDDK) (SEQ ID NO:600), StrepTag (WSHPQFEK) (SEQ ID NO:601), hemagglutinin, e.g., HA Tag (YPYDVPDYA) (SEQ ID NO:602), GST, thioredoxin, cellulose binding domain, RYIRS (SEQ ID NO:603), Phe-His-His-Thr (SEQ ID NO:064), chitin binding domain, S-peptide, T7 peptide, SH2 domain, C-end RNA tag, WEAAAREACCRECCARA (SEQ ID NO:605), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, 5100 proteins, parvalbumin, calbindin D9K, calbindin D28K, and calretinin, inteins, biotin, streptavidin, MyoD, Id, leucine zipper sequences, and maltose binding protein.

Detectable Signal-Producing Polypeptides

Suitable detectable signal-producing proteins include, e.g., fluorescent proteins; enzymes that catalyze a reaction that generates a detectable signal as a product; and the like.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilized EGFP (dEGFP), destabilized ECFP (dECFP), destabilized EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, *Renilla* GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, mPlum (Shaner et al. (2005) *Nat. Methods* 2:905-909), and the like. Any of a variety of fluorescent and colored proteins from Anthozoan species, as described in, e.g., Matz et al. (1999) *Nature Biotechnol.* 17:969-973, is suitable for use.

Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, glucose oxidase (GO), and the like.

Exemplary Conditionally Active Heterodimeric Polypeptides

In some cases, a conditionally active, heterodimeric polypeptide of the present disclosure comprises: a) a first chimeric polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second chimeric polypeptide comprising: i) a transmembrane domain; ii) a second modulatory domain; iii) a second member of the dimerization pair; and iv) an intracellular signaling domain, where i) the first and second modulatory domains are derived from 4-1BB; ii) the first and second members of the dimerization pair are SRC3 and a PPARγ LBD, respectively; and iii) the signaling domain comprises an ITAM. In some cases, the first member of the dimerization pair comprises one copy of an SRC3 co-regulator peptide. In some cases, the SRC3 co-regulator peptide has a length of from 20 amino acids to 25 amino acids. In some cases, the SRC3 co-regulator peptide has a length of from 75 amino acids to 80 amino acids. In some cases, the first chimeric polypeptide comprises a single SRC3 co-regulator peptide. In some cases, the first chimeric polypeptide comprises 2 copies of an SRC3 co-regulator peptide. In some cases, the first chimeric polypeptide comprises 3 copies of an SRC3 co-regulator peptide. In some cases, each of the copies of the SRC3 co-regulator peptide has a length of from 20 amino acids to 25 amino acids.

For example, in some cases, a conditionally active, heterodimeric polypeptide of the present disclosure comprises a first polypeptide chain comprising: i) a single chain Fv; ii) a transmembrane polypeptide; and iii) a polypeptide comprising the amino acid sequence:

(SEQ ID NO: 606)
*KRGRKKLLYIFKQPFMRPVQTTQEEDGCSCRFPEEEEGGCEL*
SRGSGSGSTS<u>PKKENNALLRYLLDRDDPSDAGS</u>*, where the 4-1BB sequence is in italics and bold text, and the co-regulator peptide is underlined (single underline). In some cases, the second polypeptide chain comprises the following amino acid sequence:

(SEQ ID NO: 607)
<u>IYIWAPLAGTCGVLLLSLVITLYCSL</u>KRGRKKLLYIFKQPFMRPVQTTQ

EEDGCSCRFPEEEEGGCELGSGSGSGSGSGSGSTSESADLRALAKHL

YDSYIKSFPLTKAKARAILTGKTTDKSPFVIYDMNSLMMGEDKIKFK

HITPLQEQSKEVAIRIFQGCQFRSVEAVQEITEYAKSIPGFVNLDLN

DQVTLLKYGVHEIIYTMLASLMNKDGVLISEGQGFMTREFLKSLRKP

FGDFMEPKFEFAVKFNALELDDSDLAIFIAVIILSGDRPGLLNVKPI

EDIQDNLLQALELQLKLNHPESSQLFAKLLQKMTDLRQIVTEHVQLL

QVIKKTETDMSLHPLLQEIYKDLYGSGSGSGSSL*RVKFSRSADA*

*PAYQQGQNQLYNELNLGRR<u>EEYDVLDKRR</u>GRDPEMGGK*

*PRRKNPQEGLYNELQKDKMAEAYSEIGMKGERRR*

*GKGHDGLYQGISTATKDTYDALHMQALPPR* where the PPARγ LBD is underlined (single underline); the CD8α TM domain is double underlined; 4-1BB is in bold text; and CD3 zeta is in bold and italics.

In some cases, the first member of a specific binding pair is an scFv specific for CD19, and the first polypeptide chain comprises a transmembrane domain between the anti-CD19 scFv and the first modulatory domain, where the first modulatory domain is 4-1BB. For example, in some cases, a conditionally active, heterodimeric polypeptide of the present disclosure comprises a first polypeptide chain comprising the following amino acid sequence:

(SEQ ID NO: 608)
DIQMTQTTSSLSASLGDRVTISCRASQDISKYLNWYQQKPDGTVKLLIYH

TSRLHSGVPSRFSGSGSGTDYSLTISNLEQEDIATYFCQQGNTLPYTFGG

GTKLEITGGGSGGGGSGGGGSEVKLQESGPGLVAPSQSLSVTCTVSGVS

LPDYGVSWIRQPPRKGLEWLGVIWGSETTYYNSALKSRLTIIKDNSKSQV

FLKMNSLQTDDTAIYYCAKHYYYGGSYAMDYWGQGTSVTVSSTTTPAPRP

PTPAPTIASQPLSLRPEACRPAAGGAVHTRGLDFACD<u>IYIWAPLAGTCGV</u>

<u>LLLSLVITLY</u>CSLKRGRKKLLYIFKQPFMRPVQTTQEEDGCSCRFPEEEEG

GCELSRGSGSGSTS<u>PKKENNALLRYLLDRDDPSDAGS</u>*, where the anti-CD19 sequence is in bold, the CD8α transmembrane (TM) domain is double underlined, the 4-1BB sequence is in italics and bold text, and the co-regulator peptide is underlined (single underline). In some cases, the second polypeptide chain comprises the following amino acid sequence:

(SEQ ID NO: 609)
<u>IYIWAPLAGTCGVLLLSLVITLYCSL</u>KRGRKKLLYIFKQPFMRPVQTT
QEED

GCSCRFPEEEEGGCELGSGSGSGSGSGSGSTSESADLRALAKHLYDSYI

KSFPLTKAKARAILTGKTTDKSPFVIYDMNSLMMGEDKIKFKHITPLQE

QSKEVAIRIFQGCQFRSVEAVQEITEYAKSIPGFVNLDLNDQVTLLKYG

```
-continued
VHEIIYTMLASLMNKDGVLISEGQGFMTREFLKSLRKPFGDFMEPKFEF

AVKFNALELDDSDLAIFIAVIILSGDRPGLLNVKPIEDIQDNLLQALEL

QLKLNHPESSQLFAKLLQKMTDLRQIVTEHVQLLQVIKKTETDMSLHPL

LQEIYKDLYGSGSGSGSSL*RVKFSRSADAPAYQQGQNQL*

*YNELNLGRREEYDVLDKRRGRDPEMGGKPRRKNPQEGLYNEL*

*QKDKMAEAYSEIGMKGERRRGKGHDGLYQGISTATKDTYD*

*ALHMQALPPR*, where the PPARγ LBD is underlined (single underline);
``` the CD8α TM domain is double underlined; 4-1BB is in bold text; and CD3 zeta is in bold and italics.

As another example, in some cases, a conditionally active, heterodimeric polypeptide of the present disclosure comprises a first polypeptide chain comprising the following amino acid sequence:

```
                                    (SEQ ID NO: 610)
DIQMTQTTSSLSASLGDRVTISCRASQDISKYLNWYQQKPDGTVKLLIYH

TSRLHSGVPSRFSGSGSGTDYSLTISNLEQEDIATYFCQQGNTLPYTFGG

GTKLEITGGGSGGGGSGGGGSEVKLQESGPGLVAPSQSLSVTCTVSGVS

LPDYGVSWIRQPPRKGLEWLGVIWGSETTYYNSALKSRLTIIKDNSKSQV

FLKMNSLQTDDTAIYYCAKHYYYGGSYAMDYWGQGTSVTVSSTTTPAPRP

PTPAPTIASQPLSLRPEACRPAAGGAVHTRGLDFACDIYIWAPLAGTCGV

LLLSLVITLYCSL*KRGRKKLLYIFKQPFMRPVQTTQEEDGCSCRF*

*PEEEEGGCEI*SRGSGSGSTSMHGSLLQEKHRILHKLLQNGNSPAEVAKI

TAEATGKDTSSITSCGDGNVVKQEQLSPKKKENNALLRYLLDRDDPSDA

GS*,
``` where the anti-CD19 sequence is in bold, the CD8α transmembrane (TM) domain is double underlined, the 4-1BB sequence is in italics and bold text, and the co-regulator peptide is underlined (single underline). In some cases, the second polypeptide chain comprises the following amino acid sequence:

```
                                    (SEQ ID NO: 611)
IYIWAPLAGTCGVLLLSLVITLYCSL*KRGRKKLLYIFKQPFMRPVQTTQE*

*EDGCSCRFPEEEEGGCEL*GSGSGSGSGSGSGSTSESADLRALAKHLYD

SYIKSFPLTKAKARAILTGKTTDKSPFVIYDMNSLMMGEDKIKFKHIT

PLQEQSKEVAIRIFQGCQFRSVEAVQEITEYAKSIPGFVNLDLNDQVT

LLKYGVHEIIYTMLASLMNKDGVLISEGQGFMTREFLKSLRKPFGDFM

EPKFEFAVKFNALELDDSDLAIFIAVIILSGDRPGLLNVKPIEDIQDN

LLQALELQLKLNHPESSQLFAKLLQKMTDLRQIVTEHVQLLQVIKKTE

TDMSLHPLLQEIYKDLYGSGSGSGSSL*RVKFSRSADAPAYQQGQNQL*

*YNELNLGRREEYDVLDKRRGRDPEMGGKPRRKNPQEGLYNEL*

*QKDKMAEAYSEIGMKGERRRGKGHDGLYQGISTATKDTYD*

*ALHMQALPPR*,
``` where the PPARγ LBD is underlined (single underline); the CD8α TM domain is double underlined; 4-1BB is in bold text; and CD3 zeta is in bold and italics.

As another example, in some cases, a conditionally active, heterodimeric polypeptide of the present disclosure comprises a first polypeptide chain comprising the following amino acid sequence:

```
                                    (SEQ ID NO: 612)
DIQMTQTTSSLSASLGDRVTISCRASQDISKYLNWYQQKPDGTVKLLIYH

TSRLHSGVPSRFSGSGSGTDYSLTISNLEQEDIATYFCQQGNTLPYTFGG

GTKLEITGGGSGGGGSGGGGSEVKLQESGPGLVAPSQSLSVTCTVSGVS

LPDYGVSWIRQPPRKGLEWLGVIWGSETTYYNSALKSRLTIIKDNSKSQV

FLKMNSLQTDDTAIYYCAKHYYYGGSYAMDYWGQGTSVTVSSTTTPAPRP

PTPAPTIASQPLSLRPEACRPAAGGAVHTRGLDFACDIYIWAPLAGTCGV

LLLSLVITLYCSL*KRGRKKLLYIFKQPFMRPVQTTQEEDSCSC*

*RFPEEEEGGCEL*SRGSGSGSTSPKKENNALLRYLLDRDDPSDAGGGSGG

GSPKKENNALLRYLLDRDDPSDAGGGSGGGSKKENNALLRYLLDRDDPS

DAGS*,
``` where the anti-CD19 sequence is in bold, the CD8α transmembrane (TM) domain is double underlined, the 4-1BB sequence is in italics and bold text, and the co-regulator peptide is underlined (single underline). In some cases, the second polypeptide chain comprises the following amino acid sequence:

```
                                    (SEQ ID NO: 613)
IYIWAPLAGTCGVLLLSLVITLYCSL*KRGRKKLLYIFKQPFMRPVQTTQE*

*EDGCSCRFPEEEEGGCEL*GSGSGSGSGSGSGSTSESADLRALAKHLY

DSYIKSFPLTKAKARAILTGKTTDKSPFVIYDMNSLMMGEDKIKFKH

ITPLQEQSKEVAIRIFQGCQFRSVEAVQEITEYAKSIPGFVNLDLND

QVTLLKYGVHEIIYTMLASLMNKDGVLISEGQGFMTREFLKSLRKPF

GDFMEPKFEFAVKFNALELDDSDLAIFIAVIILSGDRPGLLNVKPIE

DIQDNLLQALELQLKLNHPESSQLFAKLLQKMTDLRQIVTEHVQLLQ

VIKKTETDMSLHPLLQEIYKDLYGSGSGSGSSL*RVKFSRSADA*

*PAYQQGQNQLYNELNLGRREEYDVLDKRRGRDPEMGGKPRRK*

*NPQEGLYNELQKDKMAEAYSEIGMKGERRRGKGHDGLYQGL*

*STATKDTYDALHMQALPPR*,
``` where the PPARγ LBD is underlined (single underline); the CD8α TM domain is double underlined; 4-1BB is in bold text; and CD3 zeta is in bold and italics.

As another example, in some cases, a conditionally active, heterodimeric polypeptide of the present disclosure comprises: a) a first chimeric polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second chimeric polypeptide comprising: i) a transmembrane domain; ii) a second modulatory domain; iii) a second member of the dimerization pair; and iv) an intracellular signaling domain, where i) the first and second modulatory domains are derived from 4-1BB; ii) the first and second members of the dimerization pair are CoRNR and an ERα LBD, respectively; and iii) the signaling domain comprises an ITAM. In some cases, the first member of the dimerization pair comprises one copy of a CoRNR co-regulator peptide. In some cases, the CoRNR co-regulator peptide has a length of from 60 amino acids to 70 amino acids. In some cases, the first chimeric polypeptide comprises a single CoRNR co-regulator peptide. In some cases, the first chimeric polypeptide comprises 2 copies of a CoRNR co-regulator peptide. In some cases, the first chimeric polypeptide comprises 3 copies of a CoRNR co-regulator peptide. In some cases, each of the copies of the CoRNR co-regulator peptide has a length of from 15 amino acids to 20 amino acids.

For example, in some cases, a conditionally active, heterodimeric polypeptide of the present disclosure comprises a first polypeptide chain comprising: i) a single chain Fv; ii) a transmembrane polypeptide; and iii) a polypeptide comprising the amino acid sequence:

(SEQ ID NO: 614)
KRGRKKLLYIFKQPFMRPVQTTQEEDGCSCRFPEEEEGGCEL
SRGSGSGSTSDAFQLRQLILRGLQDDGGGSGGGSDAFQLRQLILRGL
QDDGGGSGGGSDAFQLRQLILRGLQDDG, where the 4-1BB amino acid sequence is in bold and italics, and the 3× CoRNR co-regulator peptide is underlined. In some cases, the second polypeptide chain comprises the following amino acid sequence:

(SEQ ID NO: 615)
IYIWAPLAGTCGVLLLSLVITLYCSLKRGRKKLLYIFKQPFMRPVQ

TTQEEDGCSCRFPEEEEGGCELGSGSGSGSGSGSGSTSDRRGGRML

KHKRQRDDGEGRGEVGSAGDMRAANLWPSPLMIKRSKKNSLALSLT

ADQMVSALLDAEPPILYSEYDPTRPFSEASMMGLLTNLADRELVHM

INWAKRVPGFVDLTLHDQVHLLECAWLEILMIGLVWRSMEHPGKLL

FAPNLLLDRNQGKCVEGMVEIFDMLLATSSRFRMMNLQGEEFVCLK

SIILLNSGVYTFLSSTLKSLEEKDHIHRVLDKITDTLIHLMAKAGL

TLQQQHQRLAQLLLILSHIRHMSNKGMEHLYSMKCKNVVPLYDLLL

EMLDAHRLHAPTS, where the TM polypeptide is double underlined, the 4-1BB amino acid sequence is in bold and italics, and the ER LBD is underlined (single underlined).

In some cases, the first member of a specific binding pair is an scFv specific for CD19, and the first polypeptide chain comprises a transmembrane domain between the anti-CD19 scFv and the first modulatory domain, where the first modulatory domain is 4-1BB. For example, in some cases, a conditionally active, heterodimeric polypeptide of the present disclosure comprises a first polypeptide chain comprising the following amino acid sequence:

(SEQ ID NO: 616)
DIQMTQTTSSLSASLGDRVTISCRASQDISKYLNWYQQKPDGTVKLLIYH

TSRLHSGVPSRFSGSGSGTDYSLTISNLEQEDIATYFCQQGNTLPYTFGG

GTKLEITGGGGSGGGGSGGGGSEVKLQESGPGLVAPSQSLSVTCTVSGVS

LPDYGVSWIRQPPRKGLEWLGVIWGSETTYYNSALKSRLTIIKDNSKSQV

FLKMNSLQTDDTAIYYCAKHYYYGGSYAMDYWGQGTSVTVSSTTTPAPRP

PTPAPTIASQPLSLRPEACRPAAGGAVHTRGLDFACDIYIWAPLAGTCGV

-continued
LLLSLVITLYCSLKRGRKKLLYIFKQPFMRPVQTTQEEDGCSCRFPEEEE

GGCELSRGSGSGSTSDAFQLRQLILRGLQDDGGGSGGGSDAFQLRQLILR

GLQDDGGGSGGGSDAFQLRQLILRGLQDDGGGSGGGSDAFQLRQLILRGL

QDDGS, where the anti-CD19 scFv is in bold, the TM region is double underlined, the 4-1BB polypeptide is in bold and italics, and the 3× CoRNR co-regulator peptide is underlined (single underlined). In some cases, the second polypeptide chain comprises the following amino acid sequence:

(SEQ ID NO: 617)
MIHLGHILFLLLLPVAAAQTTPGERSSLPAFYPGTSGSCSGCGSLSLPIY

IWAPLAGTCGVLLLSLVITLYCSLKRGRKKLLYIFKQPFMRPVQTTQEED

GCSCRFPEEEEGGCELGSGSGSGSGSGSGSTSDRRGGRMLKHKRQRDDGE

GRGEVGSAGDMRAANLWPSPLMIKRSKKNSLALSLTADQMVSALLDAEPP

ILYSEYDPTRPFSEASMMGLLTNLADRELVHMINWAKRVPGFVDLTLHDQ

VHLLECAWLEILMIGLVWRSMEHPGKLLFAPNLLLDRNQGKCVEGMVEIF

DMLLATSSRFRMMNLQGEEFVCLKSIILLNSGVYTFLSSTLKSLEEKDHI

HRVLDKITDTLIHLMAKAGLTLQQQHQRLAQLLLILSHIRHMSNKGMEHL

YSMKCKNVVPLYDLLLEMLDAHRLHAPTS, where the TM polypeptide is double underlined, the 4-1BB amino acid sequence is in bold and italics, and the ER LBD is underlined (single underlined).

Dimerization Agents

Suitable dimerization agents (also referred to as dimerizing agents; dimerizers) bind the LBD of a nuclear hormone receptor in a first polypeptide of a conditionally active, heterodimeric polypeptide of the present disclosure, and bind the co-regulator peptide in a second polypeptide of the conditionally active, heterodimeric polypeptide. Binding of to dimerization agent to the LBD and the co-regulator peptide functions to dimerize the first and second polypeptides of a conditionally active, heterodimeric polypeptide of the present disclosure.

Suitable dimerization agents are known in the art; any known dimerization agent can be used.

Examples of dimerization agents include corticosterone (11beta,21-dihydroxy-4-pregnene-3,20-dione); deoxycorticosterone (21-hydroxy-4-pregnene-3,20-dione); cortisol (11beta,17,21-trihydroxy-4-pregnene-3,20-dione); 11-deoxycortisol (17,21-dihydroxy-4-pregnene-3,20-dione); cortisone (17,21-dihydroxy-4-pregnene-3,11,20-trione); 18-hydroxycorticosterone (11beta,18,21-trihydroxy-4-pregnene-3,20-dione); 1.alpha.-hydroxycorticosterone (1 alpha, 11beta,21-trihydroxy-4-pregnene-3,20-dione); aldosterone 18,11-hemiacetal of 11beta,21-dihydroxy-3,20-dioxo-4-pregnen-18-a1, androstenedione (4-androstene-3,17-dione); 4-hydroxy-androstenedione; 11β-hydroxyandrostenedione (11 beta-4-androstene-3,17-dione); androstanediol (3-beta, 17-beta-Androstanediol); androsterone (3alpha-hydroxy-5alpha-androstan-17-one); epiandrosterone (3beta-hydroxy-5alpha-androstan-17-one); adrenosterone (4-androstene-3, 11,17-trione); dehydroepiandrosterone (3beta-hydroxy-5-androsten-17-one); dehydroepiandrosterone sulphate (3beta-sulfoxy-5-androsten-17-one); testosterone (17beta-hydroxy-4-androsten-3-one); epitestosterone (17alpha-hydroxy-4-androsten-3-one); 5α-dihydrotestosterone (17beta-hydroxy-5alpha-androstan-3-one 5β-dihydrotestosterone; 5-beta-dihydroxy testosterone (17beta-hydroxy-5beta-androstan-3-one); 11β-hydroxytestosterone (11beta,17beta-dihydroxy-4-androsten-3-one); 11-ketotestosterone (17beta-hydroxy-4-androsten-3,17-dione), estrone (3-hydroxy-1,3,5 (10)-estratrien-17-one); estradiol (1,3,5(10)-estratriene-3, 17beta-diol); estriol 1,3,5(10)-estratriene-3,16alpha,17beta-triol; pregnenolone (3-beta-hydroxy-5-pregnen-20-one); 17-hydroxypregnenolone (3-beta,17-dihydroxy-5-pregnen-20-one); progesterone (4-pregnene-3,20-dione); 17-hydroxyprogesterone (17-hydroxy-4-pregnene-3,20-dione); progesterone (pregn-4-ene-3,20-dione); T3 and T4.

Where a conditionally active, heterodimeric polypeptide of the present disclosure comprises an LBD of a mineralocorticoid receptor (MR) and a corresponding co-regulator peptide, a suitable dimerization agent includes, but is not limited to, spironolactone, and eplerenone.

Spironolactone is a compound of the following structure:

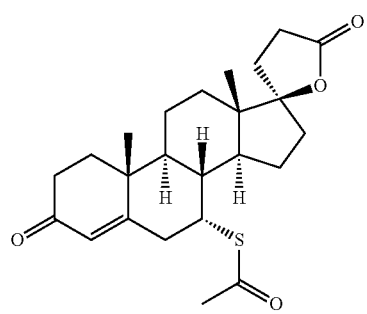

Spironolactone can be administered at a dose ranging from 10 to 35 mg per day, e.g., 25 mg per day.

Eplerenone is a compound of the following structure:

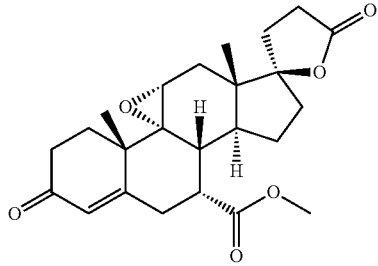

Where a conditionally active, heterodimeric polypeptide of the present disclosure comprises an LBD of an androgen receptor (AR) and a corresponding co-regulator peptide, a suitable dimerization agent includes, but is not limited to, cyproterone acetate, hydroxyflutamide, enzalutamide, ARN-509, 3,3'-diindolylmethane (DIM), bexlosteride, bicalutamide, N-butylbenzene-sulfonamide (NBBS), dutasteride, epristeride, finasteride, flutamide, izonsteride, ketoconazole, N-butylbenzene-sulfonamide, nilutamide, megestrol, a steroidal antiandrogen, and turosteride.

Cyproterone acetate is a compound of the formula:

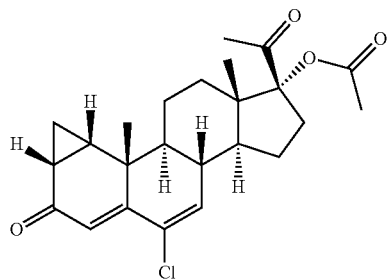

Flutamide is a compound of the formula:

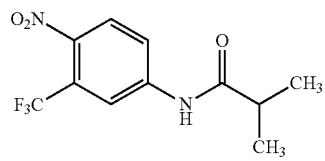 [SMILES: CC(C)C(=O)Nc1ccc([N+](=O)[O-])c(C(F)(F)F)c1]

Hydroxyflutamide is a compound of the formula:

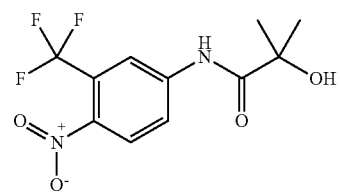

Enzalutamide is a compound of the formula:

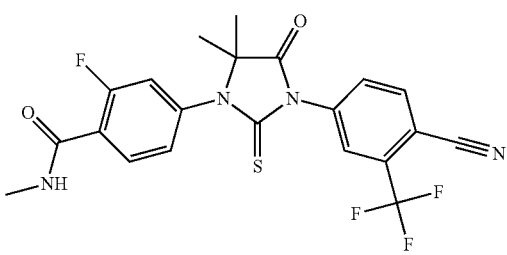 [SMILES: CNC(=O)c1ccc(N2C(=S)N(c3ccc(C#N)c(C(F)(F)F)c3)C(=O)C2(C)C)cc1F]

ARN-509 is a compound of the formula:

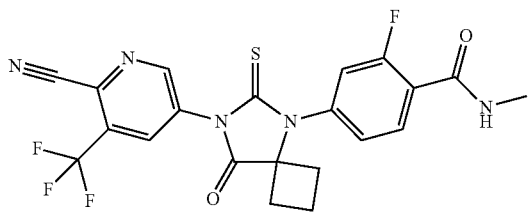 [SMILES: CNC(=O)c1ccc(N2C(=S)N(c3cnc(C#N)c(C(F)(F)F)c3)C(=O)C23CCC3)cc1F]

Where a conditionally active, heterodimeric polypeptide of the present disclosure comprises an LBD of progesterone receptor (PR) and a corresponding co-regulator peptide, a suitable dimerization agent includes, but is not limited to, mifepristone (RU-486; 11β-[4 N,N-dimethylaminophenyl]-

17β-hydroxy-17-(1-propynyl)-estra-4,9-dien-3-one); Lilopristone (11β-(4 N,N-dimethylaminophenyl)-17β-hydroxy-17-((Z)-3-hydroxypropenyl)estra-4,9-dien-3-one); onapristone (11β-(4 N,N-dimethylaminophenyl)-17α-hydroxy-17-(3-hydroxypropyl)-13α-estra-4,9-dien-3-one); asoprisnil (benzaldehyde, 4-[(11β,17β)-17-methoxy-17-(methoxymethyl)-3-oxoestra-4,9-dien-11-yl]-1-(E)-oxim; J867); J912 (4-[17β-Hydroxy-17α-(methoxymethyl)-3-oxoestra-4,9-dien-11β-yl]benzaldehyd-(1E)-oxim); and CDB-2914 (17α-acetoxy-11β-(4-N,N-dimethylaminophenyl)-19-norpregna-4,9-dien-3,20-dione). Other suitable dimerization agents include, e.g., JNJ-1250132, (6α,11β,17β)-11-(4-dimethylaminophenyl)-6-methyl-4',5'-dihydrospiro[estra-4,9-diene-17,2'(3'H)-furan]-3-one (ORG-31710); (11β,17α)-11-(4-acetylphenyl)-17,23-epoxy-19,24-dinorchola-4,9-,20-trien-3-one (ORG-33628); (7β,11β,17β)-11-(4-dimethylaminophenyl-7-methyl]-4',5'-dihydrospiro[estra-4,9-diene-17,2'(3'H)-furan]-3-one (ORG-31806); ZK-112993; ORG-31376; ORG-33245; ORG-31167; ORG-31343; RU-2992; RU-1479; RU-25056; RU-49295; RU-46556; RU-26819; LG1127; LG120753; LG120830; LG1447; LG121046; CGP-19984A; RTI-3021-012; RTI-3021-022; RTI-3021-020; RWJ-25333; ZK-136796; ZK-114043; ZK-230211; ZK-136798; ZK-98229; ZK-98734; ZK-137316; 4-[17β-Methoxy-17α-(methoxymethyl)-3-oxoestra-4,9-dien-11β-yl]benzaldehyde-1-(E)-oxime; 4-[17β-Methoxy-17α-(methoxymethyl)-3-oxoestra-4,9-dien-11β-yl]benzaldehyde-1-(E)-[O-(ethylamino)carbonyl]oxime; 4-[17β-Methoxy-17α-(methoxymethyl)-3-oxoestra-4,9-dien-11β-yl]benzaldehyde-1-(E)-[O-(ethylthio)carbonyl]oxime; (Z)-6'-(4-cyanophenyl)-9,11α-dihydro-17β-hydroxy-17α-[4-(1-oxo-3-methylbutoxy)-1-butenyl]4'H-naphtho[3',2',1'; 10,9,11]estr-4-en-3-one; 11β-(4-acetylphenyl)-17β-hydroxy-17α-(1,1,2,2,2-penta-fluoroethyl)estra-4,9-dien-3-one; 11β-(4-Acetylphenyl)-19,24-dinor-17,23-epoxy-17alpha-chola-4,9,20-trie-n-3-one; (Z)-11beta,19-[4-(3-Pyridinyl)-o-phenylene]-17beta-hydroxy-17α-[3-hydroxy-1-propenyl]-4-androsten-3-one; 11beta-[4-(1-methylethenyl)phenyl]-17α-hydroxy-17beta-β-hydroxypropyl)-13α-estra-4,9-dien-3-one; 4',5'-Dihydro-11beta-[4-(dimethylamino)phenyl]-6beta-methylspiro[estra-4,-9-dien-17beta,2'(3'H)-furan]-3-one, and drospirenone.

Where a conditionally active, heterodimeric polypeptide of the present disclosure comprises an LBD of thyroid receptor-beta (TRβ) and a corresponding co-regulator peptide, a suitable dimerization agent includes, but is not limited to, $T_3$ (3,5,3'-triiodo-L-thyronine); KB-141 (3,5-dichloro-4-(4-hydroxy-3-isopropylphenoxy)phenylacetic acid); sobetirome (also known as GC-1) (3,5-dimethyl-4-(4'-hydroxy-3'-isopropylbenzyl)-phenoxy acetic acid); GC-24 (3,5-dimethyl-4-(4'-hydroxy-3'-benzyl)benzylphenoxyacetic acid); 4-OH-PCB106 (4-OH-2',3,3',4',5'-pentachlorobiphenyl); eprotirome; MB07811 ((2R,4S)-4-(3-chlorophenyl)-2-[(3,5-dimethyl-4-(4'-hydroxy-3'-isopropylbenzyl)phenoxy)methyl]-2-oxido-[1,3,2]-dioxaphosphonane); QH2; and (3,5-dimethyl-4-(4'-hydroxy-3'-isopropylbenzyl)phenoxy) methylphosphonic acid (MB07344).

Eprotirome has the following structure:

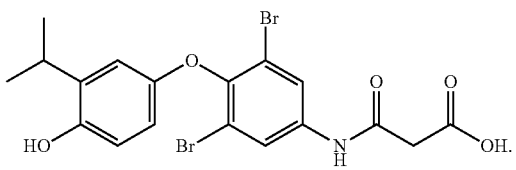 [SMILES: CC(C)c1cc(Oc2c(Br)cc(NC(=O)CC(=O)O)cc2Br)ccc1O]

QH2 has the following structure:

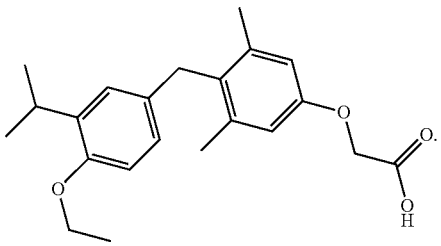 [SMILES: CCOc1ccc(Cc2c(C)cc(OCC(=O)O)cc2C)cc1C(C)C]

Where a conditionally active, heterodimeric polypeptide of the present disclosure comprises an LBD of estrogen receptor-alpha (ERα) and a corresponding co-regulator peptide, a suitable dimerization agent includes, but is not limited to, tamoxifen, 4-OH-tamoxifen, raloxifene, lasofoxifene, bazedoxifene, falsodex, clomifene, femarelle, ormeloxifene, toremifiene, ospemifene, and ethinyl estradiol.

Where a conditionally active, heterodimeric polypeptide of the present disclosure comprises an LBD of estrogen receptor-beta (ERβ) and a corresponding co-regulator peptide, a suitable dimerization agent includes, but is not limited to, estradiol (E2; or 17-beta-estradiol), and ethinyl estradiol.

Where a conditionally active, heterodimeric polypeptide of the present disclosure comprises an LBD of a PPARγ and a corresponding co-regulator peptide, a suitable dimerization agent includes, but is not limited to, a thiazolidinedione (e.g., rosiglitazone, pioglitazone, lobeglitazone, troglitazone), farglitazar, aleglitazar, and fenofibric acid.

Where a conditionally active, heterodimeric polypeptide of the present disclosure comprises an LBD of a GR and a corresponding co-regulator peptide, a suitable dimerization agent can be a selective GR agonist (SEGRA) or a selective GR modulator (SEGRM). Where a conditionally active, heterodimeric polypeptide of the present disclosure comprises an LBD of a GR and a corresponding co-regulator peptide, a suitable dimerization agent includes, but is not limited to, benzopyranoquinoline A 276575, Mapracorat, ZK 216348, 55D1E1, dexamethasone, prednisolone, prednisone, methylprednisolone, fluticasone propionate, beclomethasone-17-monopropionate, betamethasone, rimexolone, paramethasone, and hydrocortisone.

Non-limiting examples are shown below.

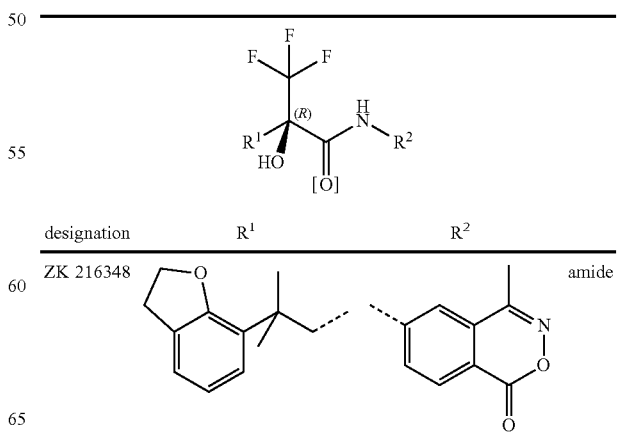

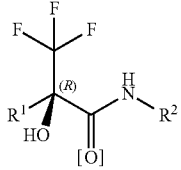

| designation | R[1] | R[2] |
|---|---|---|
| Mapracorat | (benzofuran-fluoro-dimethyl group) | quinoline amine |
| 55D1E1 | (tetralin-ethyl group) | quinoline amine |

Where a conditionally active, heterodimeric polypeptide of the present disclosure comprises an LBD of a VDR and a corresponding co-regulator peptide, a suitable dimerization agent can be 1,25-dihydroxyvitamin D3 (calcitriol), paricalitol, doxercalciferol, 25-hydroxyvitamin D3 (calcifediol), cholecalciferol, ergocalciferol, tacalciol, 22-dihydroergocalciferol, (6Z)-Tacalciol, 2-methylene-19-nor-20(S)-1α-hydroxy-bishomopregnacalciferol, 19-nor-26,27-dimethylene-20(S)-2-methylene-1α,25-dihydroxyvitamin D3, 2-methylene-1α,25-dihydroxy-(17E)-17(20)-dehydro-19-nor-vi-tamin D3, 2-methylene-19-nor-(24R)-1α,25-dihydroxyvitamin D2, 2-methylene-(20R,25S)-19,26-dinor-1α,25-dihydroxyvitamin D3, 2-methylene-19-nor-1α-hydroxy-pregnacalciferol, 1α-hydroxy-2-methylene-19-nor-homopregnacalciferol, (20R)-1α-hydroxy-2-methylene-19-nor-bishomopregnacalciferol, 2-methylene-19-nor-(20S)-1α-hydroxy-trishomopregnacalciferol, 2-methylene-23,23-difluoro-1α-hydroxy-19-nor-bishomopregnacalcifero-1, 2-methylene-(20S)-23,23-difluoro-1α-hydroxy-19-nor-bishomopregnan-calciferol, (2-(3' hydroxypropyl-1',2'-idene)-19,23,24-trinor-(20S)-1α-hydroxyvitamin D3, 2-methylene-18,19-dinor-(20S)-1α,25-dihydroxyvitamin D3, and the like.

Where a conditionally active, heterodimeric polypeptide of the present disclosure comprises an LBD of a RARβ and a corresponding co-regulator peptide, a suitable dimerization agent can be retinoic acid, all-trans-retinoic acid, 9-cis-retinoic acid, tamibarotene, 13-cis-retinoic acid, (2E,4E,6Z,8E)-3,7-dimethyl-9-(2,6,6-trimethyl-1-cyclohexeneyl)nona-2,4,6,-8-tetraenoic acid, 9-(4-methoxy-2,3,6-trimethyl-phenyl)-3,7-dimethyl-nona-2,4,6,8-tetraenoic acid, 6-[3-(1-adamantyl)-4-methoxyphenyl]-2-napthoic acid, 4-[1-(3,5,5,8,8-pentamethyl-tetralin-2-yl)ethenyl]benzoic acid, retinobenzoic acid, ethyl 6-[2-(4,4-dimethylthiochroman-6-yl)ethynyl]pyridine-3-carboxylate, retinoyl t-butyrate, retinoyl pinacol, and retinoyl cholesterol.

Where a conditionally active, heterodimeric polypeptide of the present disclosure comprises an LBD of an FXR and a corresponding co-regulator peptide, a suitable dimerization agent includes, but is not limited to, obeticholic acid, LY2562175 (6-(4-((5-cyclopropyl-3-(2,6-dichlorophenyl)isoxazol-4-yl)methoxy)piperidin-1-yl)-1-methyl-1H-indole-3-carboxylic acid), and GW4064 (3-[2-[2-Chloro-4-[[3-(2,6-dichlorophenyl)-5-(1-methylethyl)-4-isoxazolyl]methoxy]phenyl]ethenyl]benzoic acid).

Where a conditionally active, heterodimeric polypeptide of the present disclosure comprises an LBD of an LXRα and a corresponding co-regulator peptide, a suitable dimerization agent includes, but is not limited to, T0901317 (N-(2,2,2-Trifluoroethyl)-N-[4-[2,2,2-trifluoro-1-hydroxy-1-(trifluoromethyl)ethyl]phenyl]benzenesulfonamide), GW3965 (3-[3-[[[2-Chloro-3-(trifluoromethyl)phenyl]methyl](2,2-diphenylethyl)amino]propoxy]benzeneacetic acid hydrochloride), and LXR-623.

LXR-632 has the following structure:

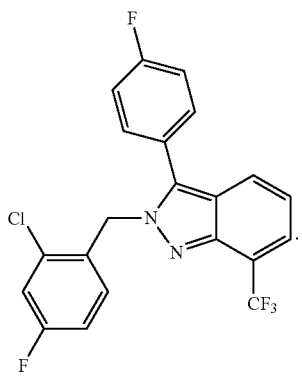 [SMILES: Fc1ccc(-c2c3cccc(C(F)(F)F)c3nn2Cc2ccc(F)cc2Cl)cc1]

Where a conditionally active, heterodimeric polypeptide of the present disclosure comprises an LBD of an RORγ and a corresponding co-regulator peptide, a suitable dimerization agent includes, but is not limited to, GNE-3500 (27, 1-{4-[3-fluoro-4-((3S,6R)-3-methyl-1,1-dioxo-6-phenyl-[1,2]thiazinan-2-ylmethyl)-phenyl]-piperazin-1-yl}-ethanone).

Where a conditionally active, heterodimeric polypeptide of the present disclosure comprises an LBD of an RORγ and a corresponding co-regulator peptide, a suitable dimerization agent includes, but is not limited to, 7β, 27-dihydroxycholesterol, and 7α, 27-dihydroxycholesterol.

Where a conditionally active, heterodimeric polypeptide of the present disclosure comprises an LBD of an RXRα and a corresponding co-regulator peptide, a suitable dimerization agent includes, but is not limited to, 9-cis retinoic acid, LGD100268, CD3254 (3-[4-Hydroxy-3-(5,6,7,8-tetrahydro-3,5,5,8,8-pentamethyl-2-naphthalenyl)phenyl]-2-propenoic acid), and CD2915 (Sorensen et al. (1997) *Skin Pharmacol.* 10:144).

LGD100268 has the following structure:

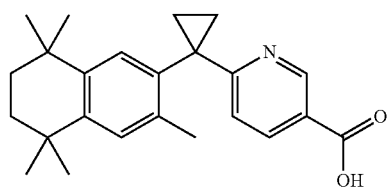 [SMILES: Cc1cc2c(cc1C1(c3ccc(C(=O)O)cn3)CC1)C(C)(C)CCC2(C)C]

Where a conditionally active, heterodimeric polypeptide of the present disclosure comprises an LBD of a PXR and a corresponding co-regulator peptide, a suitable dimerization agent can be rifampicin, chlotrimazole, and lovastatin.

Conditionally Active Off-Switch Car

In some cases, a conditionally active heterodimeric polypeptide of the present disclosure is a conditionally active off-switch CAR. A conditionally active off-switch CAR of the present disclosure is also referred to as a heteromeric, conditionally repressible synthetic immune cell receptor (ICR). A conditionally active off-switch CAR of the present disclosure comprises: a synthetic stimulatory ICR comprising a first member of a dimerization pair linked to the synthetic stimulatory ICR; and a synthetic ICR repressor comprising a second member of the dimerization pair linked to an intracellular inhibitory domain A heteromeric, conditionally repressible synthetic ICR of the present disclosure will generally include a synthetic stimulatory ICR and a synthetic ICR repressor configured such that upon introduction of a dimerizing agent, the synthetic ICR repressor dimerizes with the synthetic stimulatory ICR to repress activation due to the synthetic stimulatory ICR. Examples of heterodimeric conditionally active off-switch CAR polypeptides include but are not limited to e.g., those described in PCT International Application No. PCT/US2016/062612; the disclosure of which is incorporated herein by reference in its entirety.

The configuration of the heteromeric, conditionally repressible synthetic ICR will vary depending on the particular context within which repression of a synthetic stimulatory ICR is desired. In some instances, the stimulatory portion of the heteromeric, conditionally repressible synthetic ICR may be referred to as Part 1 of the heteromeric, conditionally repressible synthetic ICR. In some instances, the repressor portion of the heteromeric, conditionally repressible synthetic ICR may be referred to as Part 2 of the heteromeric, conditionally repressible synthetic ICR. Thus, a heteromeric, conditionally repressible synthetic ICR collectively refers to a multi-modular protein or protein complex that includes various modules including the stimulatory portion (e.g., synthetic stimulatory ICR, Part 1, etc.) and the repressor portion (e.g., synthetic ICR repressor, Part 2, etc.) whether or not the various modules are or are not present or were or were not present at some point within the same protein and whether or not the various modules are expressed from the same or different nucleic acid constructs.

One of skill in the art will readily recognize from the instant disclosure that first and second parts (e.g., stimulatory and inhibitory parts) will individually include first and second portions of a dimerizing pair and that such portions of the dimerizing pair may be interchangeable between the first and second parts of the heteromeric, conditionally repressible synthetic ICR. One of skill in the art will also readily recognize from the instant disclosure that individual domains of heteromeric, conditionally repressible synthetic ICR may be rearranged in many instances, in order and/or orientation, while maintaining the functions of being activatable and repressible as described herein. As such, description of a particular configuration of a heteromeric, conditionally repressible synthetic ICR described herein also includes wherein the modules of the heteromeric, conditionally repressible synthetic ICR are rearranged without abolishing the primary functions of the heteromeric, conditionally repressible synthetic ICR. Such rearrangements may also include the inclusion or exclusion of particular optional modules (including e.g., linkers, reporters, etc.) that do not result in abolishment of the primary functions of the heteromeric, conditionally repressible synthetic ICR due to their inclusion or exclusion from the heteromeric, conditionally repressible synthetic ICR.

Synthetic Stimulatory ICR

As described herein, a heteromeric, conditionally repressible synthetic ICR includes a synthetic stimulatory ICR, also referred to herein as a "stimulatory ICR" or "stimulatory part" for simplicity. Such stimulatory ICRs will vary depending on the particular context of immune cell stimulation to which the construct is directed and will generally function to mediate activation of the immune cell expressing the stimulatory ICR. Thus, a stimulatory ICR includes an extracellular domain that upon reception of a specific signal functions to transduce the signal to intracellularly to activate the immune cell expressing the stimulatory ICR.

In some instances, the extracellular component of a stimulatory ICR therefore may include an extracellular recognition domain, described in more detail below, which contains one member of a specific binding pair. Specific binding pairs include, but are not limited to, antigen-antibody binding pairs; ligand-receptor binding pairs; and the like. Thus, a member of a specific binding pair suitable for use in an extracellular recognition domain of the present disclosure includes an antigen; an antibody; a ligand; and a ligand-binding receptor. Suitable extracellular recognition domains for use in a stimulatory ICR include but are not limited to e.g., members of specific binding pairs (e.g., antigen-binding domain containing members of specific binding pairs) including e.g., those described above with relationship to conditionally active heterodimeric On-switch CARs above.

A stimulatory ICR further includes one or more intracellular stimulation domains that, upon activation of one or more extracellular domains, mediates intracellular signaling leading to activation of the immune cell expressing the stimulatory ICR. Domains useful as signaling domains will vary depending on the particular context of immune cell activation, including e.g., the particular type of cell to be activated and the desired degree of activation. Exemplary non-limited examples of stimulatory domains, described in greater detail below, include but are not limited to domains and motifs thereof derived from immune stimulatory molecules including, e.g., co-stimulatory molecules, immune receptors and the like. Suitable intracellular stimulation domains for use in a stimulatory ICR include but are not limited to e.g., modulatory domains and portions thereof including e.g., those described above with relationship to conditionally active heterodimeric On-switch CARs above.

In some instances, stimulatory ICRs may be or may be derived from engineered or synthetic immune regulatory constructs designed for therapeutic immune system modulation including but not limited to e.g., chimeric antigen receptors (CARs) and derivatives, engineered T cell receptors (TCRs) and derivatives and the like. Engineered CARs, TCRs and derivatives thereof useful as the basis for a synthetic ICR include those CARs, TCRs and derivatives thereof that are activatable, e.g., are activated upon binding of a binding partner to the CAR, TCR or derivative thereof, and upon activation transduce the signal intracellularly to activate the immune cell expressing the CAR, TCR or derivative thereof. In some instances, a stimulatory ICR may be conditionally activatable such that activation upon binding of a binding partner to the stimulatory ICR requires an additional event for transduction of the activation signal including e.g., dimerization of components of the stimulatory ICR.

A stimulatory ICR further includes, as described in more detail below, a domain (e.g., a first member or a second member) of a dimerization pair. Useful dimerization pairs will vary depending on the desired dimerizer and the desired relative position of the member of the dimerization pair within the stimulatory ICR. Generally, the presence of a first member of a dimerization pair within the stimulatory ICR mediates the dimerization, upon introduction of the dimerizer, with a second member of the dimerization pair present in the ICR repressor such that upon dimerization the ICR repressor represses any immune cell activation due to the stimulatory ICR.

In some instances, a stimulatory ICR may further include additional domains. Such additional domains may be functional, e.g., they directly contribute to the immune cell activation function of the stimulatory ICR, or non-functional, e.g., they do not directly contribute to the activation function of the stimulatory ICR. Non-functional additional domains may include domains having various purposes that do not directly affect the ability of the stimulatory ICR to activate immune cell function including, but not limited to, e.g., structural functions, linker functions, etc.

Chimeric Antigen Receptor (CAR)

In some instances, a heteromeric, conditionally repressible synthetic ICR may include, in part or in whole, a CAR or may essentially be a modified CAR such that by modification the CAR is conditionally repressible. In such instances, the CAR containing heteromeric, conditionally repressible synthetic ICR may be referred to as a heterodimeric, conditionally repressible synthetic CAR or, for simplicity, a repressible CAR. Any CAR having immune cell activation function may find use in a heteromeric, conditionally repressible synthetic ICR as described herein including but not limited to, e.g., those CAR variants described herein.

In some instances, a CAR may be modified for use as a component of a heterodimeric, conditionally repressible synthetic ICR through introduction or insertion of a dimerization domain (e.g., a member of a dimerization pair) into the CAR and, in such instances, following modification, the CAR may be referred to as a dimerizer-domain containing CAR or a dimerizable CAR.

A dimerizer domain may be inserted into the CAR amino acid sequence, e.g., by introducing a coding sequence for the dimerizer domain into the coding sequence of the CAR, at any convenient location provided the insertion does not negatively impact the primary functional domains of the CAR (including e.g., the extracellular recognition domain, the immune activation domain(s), etc.) and/or the negatively impact the dimerization function of the dimerizer domain.

In some instances, the dimerizer may be inserted into an extracellular portion of the CAR. In some instances the dimerizer may be inserted into an intracellular portion of the CAR. In some instances, the dimerizer may be inserted such that following insertion the dimerizer is linked to an extracellular recognition domain of the CAR. In some instances, the dimerizer may be inserted such that following insertion the dimerizer is linked to a transmembrane domain of the CAR. In some instances, the dimerizer may be inserted such that following insertion the dimerizer is linked to the extracellular side of a transmembrane domain of the CAR. In some instances, the dimerizer may be inserted such that following insertion the dimerizer is linked to the intracellular side of a transmembrane domain of the CAR. In some instances, the dimerizer may be inserted such that following insertion the dimerizer is linked to an immune stimulatory domain of the CAR. In some instances, the dimerizer may be inserted such that following insertion the dimerizer is linked to a co-stimulation domain of the CAR. In some instances, the dimerizer may be inserted such that following insertion the dimerizer is at the N-terminal end of the CAR. In some instances, the dimerizer may be inserted such that following insertion the dimerizer is at the C-terminal end of the CAR.

In instances where a heteromeric, conditionally repressible synthetic ICR includes, in part or in whole, or the heteromeric, conditionally repressible synthetic ICR is essentially a modified CAR, the CAR may contain an extracellular recognition domain, a stimulatory domain and a transmembrane domain Such a CAR may optionally include linker regions and/or hinge regions. CARs as part of a heteromeric, conditionally repressible synthetic ICR may be encompassed within a single polypeptide or may be "split" across two or more polypeptides.

Extracellular Recognition Domain

A repressible CAR includes a member of a specific binding pair. Specific binding pairs include, but are not limited to, antigen-antibody binding pairs; ligand-receptor binding pairs; and the like. Thus, a member of a specific binding pair suitable for use in a repressible CAR of the present disclosure includes an antigen; an antibody; a ligand; and a ligand-binding receptor.

Antigen Binding Domain

An antigen-binding domain suitable for use in a repressible CAR of the present disclosure can be any antigen-binding polypeptide, a wide variety of which are known in the art. In some instances, the antigen-binding domain is a single chain Fv (scFv). Other antibody based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing VαVβ) are also suitable for use. Such TCR recognition domains when present as a repressible engineered TCR rather than a component of a repressible CAR as described in more detail below.

An antigen-binding domain suitable for use in a repressible CAR of the present disclosure can have a variety of antigen-binding specificities. In some cases, the antigen-binding domain is specific for an epitope present in an antigen that is expressed by (synthesized by) a cancer cell, i.e., a cancer cell associated antigen. The cancer cell associated antigen can be an antigen associated with, e.g., a breast cancer cell, a B cell lymphoma, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma cell, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer cell associated antigen may also be expressed by a non-cancerous cell.

Non-limiting examples of antigens to which an antigen-binding domain of a subject repressible CAR can bind include, e.g., CD19, CD20, CD38, CD30, Her2/neu/ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Further examples of antigens to which an antigen-binding domain of a subject repressible CAR can bind include but are not limited to those described above with relevance to conditionally active on-switch CARs.

Ligand

In some cases, a member of a specific binding pair suitable for use in a subject repressible CAR is a ligand for a receptor. Ligands include, but are not limited to, cytokines (e.g., IL-13, etc.); growth factors (e.g., heregulin; vascular endothelial growth factor (VEGF); and the like); an integrin-binding peptide (e.g., a peptide comprising the sequence Arg-Gly-Asp); and the like.

Where the member of a specific binding pair in a subject repressible CAR is a ligand, the repressible CAR can be activated in the presence of both a dimerizer agent and a second member of the specific binding pair, where the second member of the specific binding pair is a receptor for the ligand. For example, where the ligand is VEGF, the second member of the specific binding pair can be a VEGF receptor, including a soluble VEGF receptor. As another example, where the ligand is heregulin, the second member of the specific binding pair can be Her2.

Receptors

As noted above, in some cases, the member of a specific binding pair that is included in a subject repressible CAR is a receptor, e.g., a receptor for a ligand, a co-receptor, etc. The receptor can be a ligand-binding fragment of a receptor. Suitable receptors include, but are not limited to, a growth factor receptor (e.g., a VEGF receptor); a killer cell lectin-like receptor subfamily K, member 1 (NKG2D) polypeptide (receptor for MICA, MICB, and ULB6); a cytokine receptor (e.g., an IL-13 receptor; an IL-2 receptor; etc.); Her2; CD27; a natural cytotoxicity receptor (NCR) (e.g., NKP30 (NCR3/CD337) polypeptide (receptor for HLA-B—associated transcript 3 (BAT3) and B7-H6); etc.); etc.

Stimulatory Domain

A stimulatory domain suitable for use in a stimulatory CAR of a subject repressible ICR may be any functional unit of a polypeptide as short as a 3 amino acid linear motif and as long as an entire protein, where size of the stimulatory domain is restricted only in that the domain must be sufficiently large as to retain its function and sufficiently small so as to be compatible with the other components of the repressible CAR. Accordingly, a stimulatory domain may range in size from 3 amino acids in length to 1000 amino acids or more and, in some instances, can have a length of from about 30 amino acids to about 70 amino acids (aa), e.g., a stimulatory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, stimulatory domain can have a length of from about 70 aa to about 100 aa, from about 100 aa to about 200 aa, or greater than 200 aa.

In some instances, "co-stimulatory domains" find use as stimulatory domains of a repressible CAR of the present disclosure. Co-stimulation generally refers to a secondary non-specific activation mechanism through which a primary specific stimulation is propagated. Examples of co-stimulation include antigen nonspecific T cell co-stimulation following antigen specific signaling through the T cell receptor and antigen nonspecific B cell co-stimulation following signaling through the B cell receptor. Co-stimulation, e.g., T cell co-stimulation, and the factors involved have been described in Chen & Flies. *Nat Rev Immunol* (2013) 13(4): 227-42, the disclosure of which are incorporated herein by reference in their entirety. Co-stimulatory domains are generally polypeptides derived from receptors. In some embodiments, co-stimulatory domains homodimerize. A subject co-stimulatory domain can be an intracellular portion of a transmembrane protein (i.e., the co-stimulatory domain can be derived from a transmembrane protein). Non-limiting examples of suitable co-stimulatory polypeptides include, but are not limited to, 4-1BB (CD137), CD28, ICOS, OX-40, BTLA, CD27, CD30, GITR, and HVEM. In some instances, a co-stimulatory domain, e.g., as used in repressible CAR of the instant disclosure may include a co-stimulatory domain listed in Table 1. In some instances, a co-stimulatory domain of a repressible CAR comprises a an amino acid sequence having at least about 75%, at least about 80%, at least about 85%, at least about 90%, at least about 95%, at least about 98%, or 100% amino acid sequence identity to a co-stimulatory domain as described herein.

In some instances, a stimulatory CAR may contain an intracellular signaling domain, e.g., a co-stimulatory domain, derived from an intracellular portion of a transmembrane protein listed in Table 1. For example, a suitable co-stimulatory domain can comprise an amino acid sequence having at least about 75%, at least about 80%, at least about 85%, at least about 90%, at least about 95%, at least about 98%, or 100% amino acid sequence identity to an amino acid sequence listed in Table 1. In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165, aa from about 165 aa to about 170 aa, from about 170 aa to about 175 aa, from about 175 aa to about 180 aa, from about 180 aa to about 185 aa, or from about 185 aa to about 190 aa.

In some cases, a repressible CAR may contain two more stimulatory domains, present on the same or different polypeptides. In some instances, where the repressible CAR contains two more stimulatory domains, the stimulatory domains may have substantially the same amino acid sequences. For example, in some cases, the first stimulatory domain comprises an amino acid sequence that is at least about 90%, at least about 95%, at least about 98%, at least about 99%, or 100%, identical to the amino acid sequence of the second stimulatory domain. In some instances, where the repressible CAR contains two more stimulatory domains, the stimulatory domains of the subject repressible CAR can have substantially the same length; e.g., the first and second stimulatory domains can differ in length from one another by fewer than 10 amino acids, or fewer than 5 amino acids. In some instances, where the repressible CAR contains two more stimulatory domains, the first and second stimulatory domains have the same length. In some instances, where the repressible CAR contains two more stimulatory domains, the two stimulatory domains are the same.

In some instances, a repressible CAR may contain an intracellular signaling domain, e.g., a co-stimulatory domain, derived from an intracellular portion of the transmembrane protein 4-1BB (also known as TNFRSF9;

CD137; 4-1BB; CDw137; ILA; etc.). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: KRGRKKLLY-IFKQPFMRPVQTTQEEDGCSCRFPEEEEGGCEL (SEQ ID NO:618). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein CD28 (also known as Tp44). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: FWVRSKRSRLLHSDYMNMTPRRPGPTRKHYQPYAP-PRDFAAYRS (SEQ ID NO:619). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein ICOS (also known as AILIM, CD278, and CVID1). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: TKKKYSSSVHDPNGEYMFMRAVNTAKKSRLTDVTL (SEQ ID NO:620). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein OX-40 (also known as TNFRSF4, RP5-902P8.3, ACT35, CD134, OX40, TXGP1L). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: RRDQRLPP-DAHKPPGGGSFRTPIQEEQADAHSTLAKI (SEQ ID NO:621). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein BTLA (also known as BTLA1 and CD272). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence:

(SEQ ID NO: 622)
CCLRRHQGKQNELSDTAGREINLVDAHLKSEQTEASTRQNSQVLLSETGI

YDNDPDLCFRMQEGSEVYSNPCLEENKPGIVYASLNHSVIGPNSRLARNV

KEAPTEYASICVRS.

In some instances, a repressible CAR may contain an intracellular signaling domain, e.g., a co-stimulatory domain, derived from an intracellular portion of the transmembrane protein CD27 (also known as 5152, T14, TNFRSF7, and Tp55). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HQRRKYRSNKGESPVEPAEPCRY-SCPREEEGSTIPIQEDYRKPEPACSP (SEQ ID NO:623). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein CD30 (also known as TNFRSF8, D1S166E, and Ki-1). For example, a suitable co-stimulatory domain can comprise an amino acid sequence having at least about 75%, at least about 80%, at least about 85%, at least about 90%, at least about 95%, at least about 98%, or 100% amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, from about 150 aa to about 160 aa, or from about 160 aa to about 185 aa of the following amino acid sequence:

(SEQ ID NO: 624)
RRACRKRIRQKLHLCYPVQTSQPKLELVDSRPRRSSTQLRSGASVTEPVA

EERGLMSQPLMETCHSVGAAYLESLPLQDASPAGGPSSPRDLPEPRVSTE

HTNNKIEKIYIMKADTVIVGTVKAELPEGRGLAGPAEPELEEELEADHTP

HYPEQETEPPLGSCSDVMLSVEEEGKEDPLPTAASGK.

In some instances, a repressible CAR may contain an intracellular signaling domain, e.g., a co-stimulatory domain, derived from an intracellular portion of the transmembrane protein GITR (also known as TNFRSF18, RP5-902P8.2, AITR, CD357, and GITR-D). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: HIWQLR-SQCMWPRETQLLLEVPPSTEDARSCQFPEEERGER- SAEEKGRLGDLWV (SEQ ID NO:625). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain, e.g., a co-stimulatory domain, derived from an intracellular portion of the transmembrane protein HVEM (also known as TNFRSF14, RP3-395M20.6, ATAR, CD270, HVEA, HVEM, LIGHTR, and TR2). For example, a suitable co-stimulatory domain can comprise an amino acid sequence having at least about 75%, at least about 80%, at least about 85%, at least about 90%, at least about 95%, at least about 98%, or 100% amino acid sequence identity to the following amino acid sequence: CVKRRKPRGDVVKVIVSVQRKRQEAEGEAT-VIEALQAPPDVTTVAVEETIPSFTGRSPNH (SEQ ID NO:626). In some of these embodiments, the co-stimulatory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a repressible CAR may contain an intracellular signaling domain that includes at least one (e.g., one, two, three, four, five, six, etc.) intracellular signaling motif. In some instances, the intracellular signaling motif may be an immunoreceptor tyrosine-based activation motif (ITAM). In some instances, the intracellular signaling motif, e.g., an ITAM motif is within an intracellular signaling domain derived from a signaling molecule that contains one or more ITAM motifs. In other instances, the ITAM is derived, e.g., synthetically produced, within an amino acid sequence de novo, e.g., through mutation of the amino acid sequence.

An ITAM motif is YX$_1$X$_2$L/I, where X$_1$ and X$_2$ are independently any amino acid (SEQ ID NO:564). In some cases, the intracellular signaling domain of a subject repressible CAR comprises 1, 2, 3, 4, or 5 ITAM motifs. In some cases, an ITAM motif is repeated twice in an intracellular signaling domain, where the first and second instances of the ITAM motif are separated from one another by 6 to 8 amino acids, e.g., (YX$_1$X$_2$L/I)(X$_3$)$_n$(YX$_1$X$_2$L/I), where n is an integer from 6 to 8, and each of the 6-8 X$_3$ can be any amino acid (SEQ ID NO:565). In some cases, the intracellular signaling domain of a subject repressible CAR comprises 3 ITAM motifs.

A suitable intracellular signaling domain can be an ITAM motif-containing portion that is derived from a polypeptide that contains an ITAM motif. For example, a suitable intracellular signaling domain can be an ITAM motif-containing domain from any ITAM motif-containing protein. Thus, a suitable intracellular signaling domain need not contain the entire sequence of the entire protein from which it is derived. Examples of suitable ITAM motif-containing polypeptides include, but are not limited to: DAP12; FCER1G (Fc epsilon receptor I gamma chain); CD3D (CD3 delta); CD3E (CD3 epsilon); CD3G (CD3 gamma); CD3Z (CD3 zeta); and CD79A (antigen receptor complex-associated protein alpha chain).

In some cases, the intracellular signaling domain is derived from DAP12 (also known as TYROBP; TYRO protein tyrosine kinase binding protein; KARAP; PLOSL; DNAX-activation protein 12; KAR-associated protein; TYRO protein tyrosine kinase-binding protein; killer activating receptor associated protein; killer-activating receptor-associated protein; etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to any of the following amino acid sequences (4 isoforms): MGGLEPCSRLLLLPLLLAVSGLRPVQAQAQSDCSC-STVSPGVLAGIVMGDLVLTVLIALAVYFL GRLVPR-GRGAAEAATRKQRITETESP<u>YQEL</u>QGQRSDV <u>YSDL</u>NTQRPYYK (SEQ ID NO:627); MGGLEPCSRLLLLPLLLAVSGLRPVQAQAQSDCSC-STVSPGVLAGIVMGDLVLTVLIALAVYFL GRLVPR-GRGAAEATRKQRITETESP<u>YQEL</u>QGQRSDV <u>YSDL</u>NTQRPYYK (SEQ ID NO:628); MGGLEPCSRLLLLPLLLAVSDCSCSTVSPGVLA-GIVMGDLVLTVLIALAVYFLGRLVPRGRGAA EAATRKQRITETESP<u>YQEL</u>QGQRSDV <u>YSDL</u>NTQRPYYK (SEQ ID NO:629); or MGGLEPCSRLLLLPLLLAVSDCSCSTVSPGVLA-GIVMGDLVLTVLIALAVYFLGRLVPRGRGAA EATRKQRITETESP<u>YQEL</u>QGQRSDV <u>YSDL</u>NTQRPYYK (SEQ ID NO:630), where the ITAM motifs are in bold and are underlined.

Likewise, a suitable intracellular signaling domain can comprise an ITAM motif-containing portion of the full length DAP12 amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: ESP<u>YQEL</u>QGQRSDV <u>YSDL</u>NTQ (SEQ ID NO:631), where the ITAM motifs are in bold and are underlined.

In some cases, the intracellular signaling domain is derived from FCER1G (also known as FCRG; Fc epsilon receptor I gamma chain; Fc receptor gamma-chain; fc-epsilon RI-gamma; fcRgamma; fceRI gamma; high affinity immunoglobulin epsilon receptor subunit gamma; immunoglobulin E receptor, high affinity, gamma chain; etc.). For example, a suitable intracellular signaling domain can comprise an amino acid sequence having at least about 75%, at least about 80%, at least about 85%, at least about 90%, at least about 95%, at least about 98%, or 100% amino acid sequence identity to the following amino acid sequence: MIPAVVLLLLLLVEQAAALGEPQLCYILDAILFLY-GIVLTLLYCRLKIQVRKAAITSYEKSDGV <u>YTGL</u>STRNQET<u>YETL</u>KHEKPPQ (SEQ ID NO:632), where the ITAM motifs are in bold and are underlined.

Likewise, a suitable intracellular signaling domain can comprise an ITAM motif-containing portion of the full length FCER1G amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: DGV<u>YTGL</u>STRNQET <u>YETL</u>KHE (SEQ ID NO:633), where the ITAM motifs are in bold and are underlined.

In some cases, the intracellular signaling domain is derived from T-cell surface glycoprotein CD3 delta chain (also known as CD3D; CD3-DELTA; T3D; CD3 antigen, delta subunit; CD3 delta; CD3d antigen, delta polypeptide (TiT3 complex); OKT3, delta chain; T-cell receptor T3 delta chain; T-cell surface glycoprotein CD3 delta chain; etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 170 aa, of either of the following amino acid sequences (2 isoforms): MEHSTFLSGLVLATLLSQVSPFKIPIEELEDRVFVNCNTSITWVEGTVGTLLSDITRLDLGKRILDP RGIYRCNGTDIYKDKESTVQVHYRMCQSCVELDPATVAGIIVTDVIATLLLALGVFCFAGHETG RLSGAADTQALLRNDQV YQPLRDRDDAQ<u>YSHL</u>GGNWARNK (SEQ ID NO:634) or MEHSTFLSGLVLATLLSQVSPFKIPIEELEDRVFVNCNTSITWVEGTVGTLLSDITRLDLGKRILDP RGIYRCNGTDIYKDKESTVQVHYRTADTQALLRNDQV<u>YQPL</u>RDRDDAQ YSHLGGNWARNK (SEQ ID NO:635), where the ITAM motifs are in bold and are underlined.

Likewise, a suitable intracellular signaling domain can comprise an ITAM motif-containing portion of the full length CD3 delta amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: DQV<u>YQPL</u>RDRDDAQ <u>YSHL</u>GGN (SEQ ID NO:636), where the ITAM motifs are in bold and are underlined.

In some cases, the intracellular signaling domain is derived from T-cell surface glycoprotein CD3 epsilon chain (also known as CD3e, T-cell surface antigen T3/Leu-4 epsilon chain, T-cell surface glycoprotein CD3 epsilon chain, AI504783, CD3, CD3epsilon, T3e, etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 205 aa, of the following amino acid sequence: MQSGTHWRVLGLCLLSVGVWGQDGNEEMGGITQTPYKVSISGTTVILTCPQYPGSEILWQH NDKNIGGDEDDKNIGSDEDHLSLKEFSELEQSGYYVCYPRGSKPEDANFYLYLRARVCENCME MDVMSVATIVIVDICITGGLLLLVYYWSKNRKAKAKPVTRGAGAGGRQRGQNKERPPPVPNPD <u>YEP</u>IRKGQRDL<u>YSGL</u>NQRRI (SEQ ID NO:637), where the ITAM motifs are in bold and are underlined.

Likewise, a suitable intracellular signaling domain can comprise an ITAM motif-containing portion of the full length CD3 epsilon amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: NPD<u>YEP</u>IRKGQRDL <u>YSGL</u>NQR (SEQ ID NO:638), where the ITAM motifs are in bold and are underlined.

In some cases, the intracellular signaling domain is derived from T-cell surface glycoprotein CD3 gamma chain (also known as CD3G, T-cell receptor T3 gamma chain, CD3-GAMMA, T3G, gamma polypeptide (TiT3 complex), etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 180 aa, of the following amino acid sequence: MEQGKGLAVLILAIILLQGTLAQSIKGNHLVKVYDYQEDGSVLLTCDAEAKNITWFKDGKMIGF LTEDKKKWNLGSNAKDPRGMYQCKGSQNKSKPLQVYYRMCQNCIELNAATISGFLFAEIVSIFV LAVGVYFIAGQDGVRQSRASDKQTLLPNDQL <u>YQPL</u>KDREDDQ<u>YSHL</u>QGNQLRRN (SEQ ID NO:639), where the ITAM motifs are in bold and are underlined.

Likewise, a suitable intracellular signaling domain can comprise an ITAM motif-containing portion of the full length CD3 gamma amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: DQL<u>YQPL</u>KDREDDQ <u>YSHL</u>QGN (SEQ ID NO:640), where the ITAM motifs are in bold and are underlined.

In some cases, the intracellular signaling domain is derived from T-cell surface glycoprotein CD3 zeta chain (also known as CD3Z, T-cell receptor T3 zeta chain, CD247, CD3-ZETA, CD3H, CD3Q, T3Z, TCRZ, etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 140 aa, from about 140 aa to about 150 aa, or from about 150 aa to about 160 aa, of either of the following amino acid sequences (2 isoforms): MKWKALFTAAILQAQLPITEAQSFGLLDPKLCYLLDGILFIYGVILTALFLRVKFSRSADAPAYQ QGQNQL<u>YNEL</u>NLGRREE YDVLDKRRGRDPEMGGKPRRKNPQEGL <u>YNEL</u>QKDKMAEA<u>YSEI</u>G MKGERRRGKGHDGL <u>YQGL</u>STATKDT<u>YDAL</u>HMQALPPR (SEQ ID NO:641) or MKWKALFTAAILQAQLPITEAQSFGLLDPKLCYLLDGILFIYGVILTALFLRVKFSRSADAPAYQ QGQNQL <u>YNEL</u>NLGRREE YDVLDKRRGRDPEMGGKPQRRKNPQEGL <u>YNEL</u>QKDKMAEA<u>YSEI</u> GMKGERRRGKGHDGL <u>YQGL</u>STATKDT<u>YDAL</u>HMQALPPR(SEQ ID NO:642), where the ITAM motifs are in bold and are underlined.

Likewise, a suitable intracellular signaling domain can comprise an ITAM motif-containing portion of the full length CD3 zeta amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to any of the following amino acid sequences: RVKFSRSADAPAYQQGQNQL<u>YNEL</u>NLGRREE YDVLDKRRGRDPEMGGKPRRKNPQEGL <u>YNEL</u>QKDKMAEA<u>YSEI</u>GMKGERRRGKGHDGL <u>YQGL</u>STATKDT<u>YDAL</u>HMQALPPR (SEQ ID NO:643);

NQLYNELNLGRREEYDVLDKR (SEQ ID NO:644); EGLYNELQKDKMAEAYSEIGMK (SEQ ID NO:645); or DGLYQGLSTATKDTYDALHMQ (SEQ ID NO:646), where the ITAM motifs are in bold and are underlined.

In some cases, the intracellular signaling domain is derived from CD79A (also known as B-cell antigen receptor complex-associated protein alpha chain; CD79a antigen (immunoglobulin-associated alpha); MB-1 membrane glycoprotein; ig-alpha; membrane-bound immunoglobulin-associated protein; surface IgM-associated protein; etc.). For example, a suitable intracellular signaling domain can comprise an amino acid sequence having at least about 75%, at least about 80%, at least about 85%, at least about 90%, at least about 95%, at least about 98%, or 100%, amino acid sequence identity to a contiguous stretch of from about 100 amino acids to about 110 amino acids (aa), from about 110 aa to about 115 aa, from about 115 aa to about 120 aa, from about 120 aa to about 130 aa, from about 130 aa to about 150 aa, from about 150 aa to about 200 aa, or from about 200 aa to about 220 aa, of either of the following amino acid sequences (2 isoforms): MPGGPGVLQALPATIFLLFLL-SAVYLGPGCQALWMHKVPASLMVSLGE-DAHFQCPHNSSNNAN VTWWRVLHGNYTWPPE-FLGPGEDPNGTLIIQNVNKSHGGIYVCRVQEGNESY-QQSCGTYLRVR QPPPRPFLDMGEGTKNRIITAE-GIILLFCAVVPGTLLL-FRKRWQNEKLGLDAGDEYEDENLYEGL NLDDCSMYEDISRGLQGTYQDVGSLNIGDVQLEKP (SEQ ID NO:647); or MPGGPGVLQALPATIFLLFLL-SAVYLGPGCQALWMHKVPASLMVSLGE-DAHFQCPHNSSNNAN VTWWRVLHGNYTWPPE-FLGPGEDPNEPPPRPFLDMGEGTKNRIITAEGIILLFC-AVVPGTLLLFR KRWQNEKLGLDAGDEYEDENLY-EGLNLDDCSMYEDISR-GLQGTYQDVGSLNIGDVQLEKP (SEQ ID NO:648), where the ITAM motifs are in bold and are underlined.

Likewise, a suitable intracellular signaling domain can comprise an ITAM motif-containing portion of the full length CD79A amino acid sequence. Thus, a suitable intracellular signaling domain can comprise an amino acid sequence having at least about 75%, at least about 80%, at least about 85%, at least about 90%, at least about 95%, at least about 98%, or 100%, amino acid sequence identity to the following amino acid sequence: ENLYEGLNLDDCSMYEDISRG (SEQ ID NO:649), where the ITAM motifs are in bold and are underlined.

In some instances, a repressible CAR may contain an intracellular signaling domain derived from a DAP10/CD28 type signaling chain. Intracellular signaling domains suitable for use in a repressible CAR of the present disclosure include a DAP10/CD28 type signaling chain.

An example of a DAP10 signaling chain is the amino acid sequence is: RPRRSPAQDGKVYINMPGRG (SEQ ID NO:650). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence RPRRSPAQDGKVYINMPGRG (SEQ ID NO:651).

An example of a CD28 signaling chain is the amino acid sequence is FWVLVVVGGVLACYSLLVTVAFIIFWVR-SKRSRLLHSDYMNMTPRRPGPTRKHYQPYAPPRDF AAYRS (SEQ ID NO:652). In some embodiments, a suitable intracellular signaling domain comprises an amino acid sequence having at least about 85%, at least about 90%, at least about 95%, at least about 98%, or at least about 99%, amino acid sequence identity to the entire length of the amino acid sequence FWVLVVVGGVLACYSLL-VTVAFIIFWVRSKRSRLLHSDYMNMTPRRPGPTRKHYQPYAPPRDF AAYRS (SEQ ID NO:653).

Intracellular signaling domains suitable for use in a CAR of the present disclosure include a ZAP70 polypeptide, e.g., a polypeptide comprising an amino acid sequence having at least about 85%, at least about 90%, at least about 95%, at least about 98%, at least about 99%, or 100%, amino acid sequence identity to a contiguous stretch of from about 300 amino acids to about 400 amino acids, from about 400 amino acids to about 500 amino acids, or from about 500 amino acids to 619 amino acids, of the following amino acid sequence:

```
                                   (SEQ ID NO: 654)
MPDPAAHLPFFYGSISRAEAEEHLKLAGMADGLFLLRQCLRSLGGYVLSL

VHDVRFHHFPIERQLNGTYAIAGGKAHCGPAELCEFYSRDPDGLPCNLRK

PCNRPSGLEPQPGVFDCLRDAMVRDYVRQTWKLEGEALEQAIISQAPQVE

KLIATTAHERMPWYHSSLTREEAERKLYSGAQTDGKFLLRPRKEQGTYAL

SLIYGKTVYHYLISQDKAGKYCIPEGTKFDTLWQLVEYLKLKADGLIYCL

KEACPNSSASNASGAAAPTLPAHPSTLTHPQRRIDTLNSDGYTPEPARIT

SPDKPRPMPMDTSVYESPYSDPEELKDKKLFLKRDNLLIADIELGCGNFG

SVRQGVYRMRKKQIDVAIKVLKQGTEKADTEEMMREAQIMHQLDNPYIVR

LIGVCQAEALMLVMEMAGGGPLHKFLVGKREEIPVSNVAELLHQVSMGMK

YLEEKNFVHRDLAARNVLLVNRHYAKISDFGLSKALGADDSYYTARSAGK

WPLKWYAPECINFRKFSSRSDVWSYGVTMWEALSYGQKPYKKMKGPEVMA

FIEQGKRMECPPECPPELYALMSDCWIYKWEDRPDFLTVEQRMRACYYSL

ASKVEGPPGSTQKAEAACA.
```

Transmembrane Domain

Any transmembrane (TM) domain that provides for insertion of a polypeptide into the cell membrane of a eukaryotic (e.g., mammalian) cell is suitable for use. As one non-limiting example, the TM sequence IYI-WAPLAGTCGVLLLSLVITLYC (SEQ ID NO:655) can be used. Additional non-limiting examples of suitable TM sequences include: a) CD8 beta derived: LGLL-VAGVLVLLVSLGVAIHLCC (SEQ ID NO:656); b) CD4 derived: ALIVLGGVAGLLLFIGLGIFFCVRC (SEQ ID NO:657); c) CD3 zeta derived: LCYLLDGILFIYGVILT-ALFLRV (SEQ ID NO:658); d) CD28 derived: WVLVVVGGVLACYSLLVTVAFIIFWV (SEQ ID NO:659); e) CD134 (OX40) derived: VAAILGLGLVLGLLGPLAILLALYLL (SEQ ID NO:660); and f) CD7 derived: ALPAALAVISFLLGLGLGVACVLA (SEQ ID NO:661).

Linkers

In some cases, a subject repressible CAR includes a linker between any two adjacent domains. For example, a linker can be disposed between the transmembrane domain and the first intracellular functional domain, e.g., a co-stimulatory domain, of the repressible CAR. As another example, a linker can be disposed between a first intracellular functional domain and the member of the dimerization domain of the repressible CAR. As another example, a linker can be disposed between the member of the dimerization domain and a second intracellular functional domain, e.g., an immune cell activation domain. As another example, a linker can be disposed between any domain of the repressible CAR and any additional domain including e.g., a domain not involved in the primary immune activation functions of the CAR including but not limited to e.g., a reporter domain, a tag domain, etc.

Linkers may be utilized in a suitable configuration in the repressible CAR provided they do not abolish the primary activities of the repressible CAR including, e.g., the ability of the repressible CAR to become activated upon extracellular binding, the ability of the dimerization domain of the repressible CAR to bind the dimerization domain of the ICR repressor.

A linker peptide may have any of a variety of amino acid sequences. Proteins can be joined by a spacer peptide, generally of a flexible nature, although other chemical linkages are not excluded. A linker can be a peptide of between about 6 and about 40 amino acids in length, or between about 6 and about 25 amino acids in length. These linkers can be produced by using synthetic, linker-encoding oligonucleotides to couple the proteins. Peptide linkers with a degree of flexibility can be used. The linking peptides may have virtually any amino acid sequence, bearing in mind that suitable linkers will have a sequence that results in a generally flexible peptide. The use of small amino acids, such as glycine and alanine, are of use in creating a flexible peptide. The creation of such sequences is routine to those of skill in the art.

Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, or 7 amino acids.

Exemplary flexible linkers include glycine polymers $(G)_n$, glycine-serine polymers (including, for example, $(GS)_n$, $GSGGS_n$ (SEQ ID NO:516) and $GGGS_n$ (SEQ ID NO:517), where n is an integer of at least one), glycine-alanine polymers, alanine-serine polymers, and other flexible linkers known in the art. Glycine and glycine-serine polymers are of interest since both of these amino acids are relatively unstructured, and therefore may serve as a neutral tether between components. Glycine polymers are of particular interest since glycine accesses significantly more phi-psi space than even alanine, and is much less restricted than residues with longer side chains (see Scheraga, Rev. Computational Chem. 11173-142 (1992)). Exemplary flexible linkers include, but are not limited GGSG (SEQ ID NO:518), GGSGG (SEQ ID NO:519), GSGSG (SEQ ID NO:520), GSGGG (SEQ ID NO:521), GGGSG (SEQ ID NO:522), GSSSG (SEQ ID NO:523), and the like. The ordinarily skilled artisan will recognize that design of a peptide conjugated to any elements described above can include linkers that are all or partially flexible, such that the linker can include a flexible linker as well as one or more portions that confer less flexible structure.

Hinge Regions

In some cases, the first polypeptide of a subject repressible CAR comprises a hinge region (also referred to herein as a "spacer"), where the hinge region is interposed between the antigen-binding domain and the transmembrane domain. In some cases, the hinge region is an immunoglobulin heavy chain hinge region. In some cases, the hinge region is a hinge region polypeptide derived from a receptor (e.g., a CD8-derived hinge region).

The hinge region can have a length of from about 4 amino acids to about 50 amino acids, e.g., from about 4 aa to about 10 aa, from about 10 aa to about 15 aa, from about 15 aa to about 20 aa, from about 20 aa to about 25 aa, from about 25 aa to about 30 aa, from about 30 aa to about 40 aa, or from about 40 aa to about 50 aa.

Suitable spacers can be readily selected and can be of any of a number of suitable lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and can be 1, 2, 3, 4, 5, 6, or 7 amino acids.

Exemplary spacers include glycine polymers $(G)_n$, glycine-serine polymers (including, for example, $(GS)_n$, $(GSGGS)_n$ (SEQ ID NO:516) and $(GGGS)_n$ (SEQ ID NO:517), where n is an integer of at least one), glycine-alanine polymers, alanine-serine polymers, and other flexible linkers known in the art. Glycine and glycine-serine polymers can be used; both Gly and Ser are relatively unstructured, and therefore can serve as a neutral tether between components. Glycine polymers can be used; glycine accesses significantly more phi-psi space than even alanine, and is much less restricted than residues with longer side chains (see Scheraga, Rev. Computational Chem. 11173-142 (1992)). Exemplary spacers can comprise amino acid sequences including, but not limited to, GGSG (SEQ ID NO:518), GGSGG (SEQ ID NO:519), GSGSG (SEQ ID NO:520), GSGGG (SEQ ID NO:521), GGGSG (SEQ ID NO:522), GSSSG (SEQ ID NO:523), and the like.

In some cases, e.g., when the stimulatory ICR portion of a repressible CAR is split between two or more polypeptides the repressible CAR may include a hinge region that includes at least one cysteine. For example, in some cases, the hinge region can include the sequence Cys-Pro-Pro-Cys. If present, a cysteine in the hinge region of a first polypeptide, e.g., a first portion of a repressible CAR, can be available to form a disulfide bond with a hinge region in a second polypeptide, e.g., a second portion of a repressible CAR.

Immunoglobulin hinge region amino acid sequences are known in the art; see, e.g., Tan et al. (1990) Proc. Natl. Acad. Sci. USA 87:162; and Huck et al. (1986) Nucl. Acids Res. 14:1779. As non-limiting examples, an immunoglobulin hinge region can include one of the following amino acid sequences: DKTHT (SEQ ID NO:524); CPPC (SEQ ID NO:525); CPEPKSCDTPPPCPR (SEQ ID NO:526) (see, e.g., Glaser et al. (2005) J. Biol. Chem. 280:41494); ELKTPLGDTTHT (SEQ ID NO:527); KSCDKTHTCP (SEQ ID NO:528); KCCVDCP (SEQ ID NO:529); KYGPPCP (SEQ ID NO:530); EPKSCDKTHTCPPCP (SEQ ID NO:531) (human IgG1 hinge); ERKCCVECPPCP (SEQ ID NO:532) (human IgG2 hinge); ELKTPLGDTTH-TCPRCP (SEQ ID NO:533) (human IgG3 hinge); SPNMVPHAHHAQ (SEQ ID NO:534) (human IgG4 hinge); and the like.

The hinge region can comprise an amino acid sequence of a human IgG1, IgG2, IgG3, or IgG4, hinge region. The hinge region can include one or more amino acid substitutions and/or insertions and/or deletions compared to a wild-type (naturally-occurring) hinge region. For example, $His_{229}$ of human IgG1 hinge can be substituted with Tyr, so that the hinge region comprises the sequence EPKSCDKTYTCPPCP (SEQ ID NO:535); see, e.g., Yan et al. (2012) J. Biol. Chem. 287:5891.

The hinge region can comprise an amino acid sequence derived from human CD8; e.g., the hinge region can comprise the amino acid sequence: TTTPAPRPPTPAPTIASQPLSLRPEACRPAAGGAVHTRGLDFACD (SEQ ID NO:536), or a variant thereof.

Dimerization Domain

As noted above, heterodimeric, conditionally repressible synthetic immune cell receptor (ICR) of the present disclosure comprises a first member of a dimerization pair, and a second member of a dimerization pair. One of the members of the dimerization pair will comprise an LBD of a nuclear hormone receptor; the other member of the dimerization pair will comprise a co-regulator peptide of the same nuclear hormone receptor. In the presence of a dimerization agent (e.g., a nuclear hormone, or a functional derivative or analog of the nuclear hormone), the members of the dimerization pair will bind to one another, and will effect dimerization of the two polypeptide chains of the conditionally repressible synthetic ICR of the present disclosure. A first member of a dimerization pair, or a second member of a dimerization pair, can also be referred to as a "dimerization domain."

Ligand-Binding Domain (LBD)

A ligand-binding domain of a nuclear hormone receptor can be from any of a variety of nuclear hormone receptors, including, but not limited to, ERα, ERβ, PR, AR, GR, MR, RARα, RARβ, RARγ, TRα, TRβ, VDR, EcR, RXRα, RXRβ, RXRγ, PPARα, PPARβ, PPARγ, LXRα, LXRβ, FXR, PXR, SXR, CAR, SF-1, LRH-1, DAX-1, SHP, TLX, PNR, NGF1-Bα, NGF1-Bβ, NGF1-Bγ, RORα, RORβ, RORγ, ERRα, ERRβ, ERRγ, GCNF, TR2/4, HNF-4, COUP-TFα, COUP-TFβ and COUP-TFγ.

Abbreviations for nuclear hormone receptors are as follows. ER: Estrogen Receptor; PR: Progesterone Receptor; AR: Androgen Receptor; GR: Glucocorticoid Receptor; MR: Mineralocorticoid Receptor; RAR: Retinoic Acid Receptor; TRα, β: Thyroid Receptor; VDR: Vitamin D3 Receptor; EcR: Ecdysone Receptor; RXR: Retinoic Acid X Receptor; PPAR: Peroxisome Proliferator Activated Receptor; LXR: Liver X Receptor; FXR: Farnesoid X Receptor; PXR/SXR: Pregnane X Receptor/Steroid and Xenobiotic Receptor; CAR: Constitutive Adrostrane Receptor; SF-1: Steroidogenic Factor 1; DAX-1: Dosage sensitive sex reversal-adrenal hypoplasia congenital critical region on the X chromosome, gene 1; LRH-1: Liver Receptor Homolog 1; SHP: Small Heterodimer Partner; TLX: Tail-less Gene; PNR: Photoreceptor-Specific Nuclear Receptor; NGF1-B: Nerve Growth Factor; ROR: RAR related orphan receptor; ERR: Estrogen Related Receptor; GCNF: Germ Cell Nuclear Factor; TR2/4: Testicular Receptor; HNF-4: Hepatocyte Nuclear Factor; COUP-TF: Chicken Ovalbumin Upstream Promoter, Transcription Factor.

In some cases, a polypeptide chain of a heterodimeric polypeptide of the present disclosure comprises a single LBD of a nuclear hormone receptor. In some cases, a polypeptide chain of a heterodimeric polypeptide of the present disclosure comprises multiple (two or more) LBD of a nuclear hormone receptor. In some cases, a polypeptide chain of a heterodimeric polypeptide of the present disclosure comprises two LBD of a nuclear hormone receptor. In some cases, a polypeptide chain of a heterodimeric polypeptide of the present disclosure comprises three LBD of a nuclear hormone receptor. Where a polypeptide chain of a heterodimeric polypeptide of the present disclosure comprises multiple (two or more) LBD of a nuclear hormone receptor, in some cases the multiple LBD comprise identical amino acid sequences. In some cases, the two or more LBD are in tandem, either directly or separated by a linker.

Mineralocorticoid Receptor

In some cases, an LBD suitable for inclusion as a member of a dimerization pair of a conditionally active, heterodimeric polypeptide of the present disclosure is an LBD of a mineralocorticoid receptor (MR). For example, in some cases, the LBD comprises an amino acid sequence having at least 75%, at least 80%, at least 85%, at least 90%, at least 95%, at least 98%, at least 99%, or 100%, amino acid sequence identity to the LBD of an MR having the amino acid sequence depicted in FIG. 1A.

As one non-limiting example, the LBD of a MR can comprise an amino acid sequence having at least 75%, at least 80%, at least 85%, at least 90%, at least 95%, at least 98%, at least 99%, or 100%, amino acid sequence identity to an amino acid sequence depicted in FIG. 1F; and has a length of from about 200 amino acids to 250 amino acids (e.g., has a length of from 200 amino acids to 225 amino acids, or from 225 amino acids to 250 amino acids; e.g., has a length of 248 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1B; and has a length of from about 250 amino acids to 299 amino acids (e.g., has a length of from 250 amino acids to 275 amino acids, or from 275 amino acids to 299 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1C; and has a length of from about 200 amino acids to 250 amino acids (e.g., has a length of from 200 amino acids to 225 amino acids, or from 225 amino acids to 250 amino acids; e.g., has a length of 248 amino acids).

As another non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1D, and has an S810L substitution (where the amino acid numbering is based on the amino acid sequence depicted in FIG. 1A); and has a length of from about 250 amino acids to 299 amino acids (e.g., has a length of from 250 amino acids to 275 amino acids, or from 275 amino acids to 299 amino acids).

As one non-limiting example, the LBD of a MR can comprise an amino acid sequence having at least 75%, at least 80%, at least 85%, at least 90%, at least 95%, at least 98%, at least 99%, or 100%, amino acid sequence identity to the amino acid sequence depicted in FIG. 1C, and has an S810L substitution (where the amino acid numbering is based on the amino acid sequence depicted in FIG. 1A); and has a length of from about 200 amino acids to 250 amino acids (e.g., has a length of from 200 amino acids to 225 amino acids, or from 225 amino acids to 250 amino acids; e.g., has a length of 248 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence SLTARHKILHRLLQEGSPSDI (SEQ ID NO:2), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence SLTARHKILHRLLQEGSPSDI (SEQ ID NO:2), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence QEAEEPSLLKKLL-LAPANTQL (SEQ ID NO:6), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence QEAEEPSLLKKLLLAPANTQL (SEQ ID NO:6), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an MR, the second member of the dimerization pair is a co-regulator peptide comprising the amino acid sequence SKVSQNPILT-SLLQITGNGGS (SEQ ID NO:7), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an MR, the first member of the dimerization pair is a co-regulator peptide comprising the amino acid sequence SKVSQNPILT-SLLQITGNGGS (SEQ ID NO:7), where the co-regulator peptide has a length of from about 21 amino acids to about 50 amino acids (e.g., the co-regulator peptide has a length of from 21 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Androgen Receptor

In some cases, an LBD suitable for inclusion as a member of a dimerization pair of a conditionally active, heterodimeric polypeptide of the present disclosure is an LBD of an androgen receptor (AR). For example, in some cases, the LBD comprises an amino acid sequence having at least 75%, at least 80%, at least 85%, at least 90%, at least 95%, at least 98%, at least 99%, or 100%, amino acid sequence identity to the LBD of an AR having the amino acid sequence depicted in FIG. 2A.

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B; and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C; and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has a T877A substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has a T877A substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has an F876L substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has an F876L substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2B, and has a T877A and an F876L substitution (where the amino acid numbering is based on the amino acid sequence depicted in FIG. 2A); and has a length of from about 250 amino acids to 301 amino acids (e.g., has a length of from 250 amino acids to 275 amino acids, or from 275 amino acids to 301 amino acids).

As one non-limiting example, the LBD of an AR can comprise an amino acid sequence having at least 75%, at least 80%, at least 85%, at least 90%, at least 95%, at least 98%, at least 99%, or 100%, amino acid sequence identity to the amino acid sequence depicted in FIG. 2C, and has a T877A and an F876L substitution (where the amino acid numbering is based on the amino acid sequence depicted in FIG. 2A); and has a length of from about 190 amino acids to 230 amino acids (e.g., has a length of from 190 amino acids to 210 amino acids, or from 210 amino acids to 230 amino acids).

In some cases, where the first member of a dimerization pair of a conditionally active, heterodimeric polypeptide of the present disclosure is an LBD of an AR, the second member of the dimerization pair is a co-regulator peptide comprising the amino acid sequence ESKGHKKLLQLLTCSSDDR (SEQ ID NO:3), where the co-regulator peptide has a length of from about 19 amino acids to about 50 amino acids (e.g., the co-regulator peptide has a length of from 19 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an AR, the first member of the dimerization pair is a co-regulator peptide comprising the amino acid sequence ESKGHKKLLQLLTCSSDDR (SEQ ID NO:3), where the co-regulator peptide has a length of from about 19 amino acids to about 50 amino acids (e.g., the co-regulator peptide has a length of from 19 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Progesterone Receptor

In some cases, an LBD suitable for inclusion as a member of a dimerization pair of a conditionally active, heterodimeric polypeptide of the present disclosure is an LBD of a progesterone receptor (PR). For example, in some cases, the LBD comprises an amino acid sequence having at least 75%, at least 80%, at least 85%, at least 90%, at least 95%, at least 98%, at least 99%, or 100%, amino acid sequence identity to the LBD of a PR having the amino acid sequence depicted in FIG. 3A.

As one non-limiting example, the LBD of a PR can comprise an amino acid sequence having at least 75%, at least 80%, at least 85%, at least 90%, at least 95%, at least 98%, at least 99%, or 100%, amino acid sequence identity to an amino acid sequence depicted in FIG. 3D; and has a length of from about 200 amino acids to 250 amino acids (e.g., has a length of from 200 amino acids to 225 amino acids, or from 225 amino acids to 250 amino acids; e.g., has a length of 248 amino acids).

As one non-limiting example, the LBD of a PR can comprise an amino acid sequence having at least 75%, at least 80%, at least 85%, at least 90%, at least 95%, at least 98%, at least 99%, or 100%, amino acid sequence identity to the amino acid sequence depicted in FIG. 3B; and has a length of from about 200 amino acids to 256 amino acids (e.g., has a length of from 200 amino acids to 225 amino acids, or from 225 amino acids to 256 amino acids; e.g., has a length of 256 amino acids).

As one non-limiting example, the LBD of a PR can comprise an amino acid sequence having at least 75%, at least 80%, at least 85%, at least 90%, at least 95%, at least 98%, at least 99%, or 100%, amino acid sequence identity to the amino acid sequence depicted in FIG. 3C; and has a length of from about 200 amino acids to 250 amino acids (e.g., has a length of from 200 amino acids to 225 amino acids, or from 225 amino acids to 250 amino acids; e.g., has a length of 248 amino acids).

In some cases, where the first member of a dimerization pair of a conditionally active, heterodimeric polypeptide of the present disclosure is an LBD of a PR, the second member of the dimerization pair is a co-regulator peptide comprising the amino acid sequence GHSFADPASNLGLEDIIRKA-LMGSF (SEQ ID NO:8), where the co-regulator peptide has a length of from about 25 amino acids to about 50 amino acids (e.g., the co-regulator peptide has a length of from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PR, the first member of the dimerization pair is a co-regulator peptide comprising the amino acid sequence GHS-FADPASNLGLEDIIRKALMGSF (SEQ ID NO:8), where the co-regulator peptide has a length of from about 25 amino acids to about 50 amino acids (e.g., the co-regulator peptide has a length of from 25 amino acids to 30 amino acids, from 30 amino acids to 35 amino acids, from 35 amino acids to 40 amino acids, from 40 amino acids to 45 amino acids, or from 45 amino acids to 50 amino acids).

Thyroid Hormone Receptor-β

In some cases, an LBD suitable for inclusion as a member of a dimerization pair of a conditionally active, heterodimeric polypeptide of the present disclosure is an LBD of thyroid hormone receptor-beta (TRβ). For example, in some cases, the LBD comprises an amino acid sequence having at least 75%, at least 80%, at least 85%, at least 90%, at least 95%, at least 98%, at least 99%, or 100%, amino acid sequence identity to the LBD of a TRβ having the amino acid sequence depicted in FIG. 4A.

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 4D; and has a length of from about 200 amino acids to 250 amino acids (e.g., has a length of from 200 amino acids to 225 amino acids, from 225 amino acids to 230 amino acids, from 230 amino acids to 240 amino acids, or from 240 amino acids to 250 amino acids).

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to the amino acid sequence depicted in FIG. 4B; and has a length of from about 200 amino acids to 260 amino acids (e.g., has a length of from 200 amino acids to 225 amino acids, or from 225 amino acids to 260 amino acids; e.g., has a length of 260 amino acids).

As one non-limiting example, the LBD of a TRβ can comprise an amino acid sequence having at least 75%, at least 80%, at least 85%, at least 90%, at least 95%, at least 98%, at least 99%, or 100%, amino acid sequence identity to the amino acid sequence depicted in FIG. 4B; and has a length of from about 200 amino acids to 246 amino acids (e.g., has a length of from 200 amino acids to 225 amino acids, or from 225 amino acids to 246 amino acids; e.g., has a length of 246 amino acids).

In some cases, where the first member of a dimerization pair of a conditionally active, heterodimeric polypeptide of the present disclosure is an LBD of a TRβ, the second member of the dimerization pair is an NCOA3/SRC3 polypeptide. For example, in some cases, where the first member of a dimerization pair of a conditionally active, heterodimeric polypeptide of the present disclosure is an LBD of a TRβ, the second member of the dimerization pair is a co-regulator peptide comprises the amino acid sequence CSSDDRGHSSLTNSPLDSSCKESSVSVTSPSGVSSST-SGGVSSTSNMHGSLLQEKHRILHKLLQNG NSPAEVA-KITAEATGKDTSSITSCGDGNVVKQEQLSPKKKEN-NALLRYLLDRDDPSDALSKELQ PQVEGVDNKMSQCTSSTIPSSSQEKDPKIKTET-SEEGSGDLDNLDAILGDLTSSDFYNNSISSNGS HLGTKQQ (SEQ ID NO:662). In other cases, where the second member of a dimerization pair of a conditionally active, heterodimeric polypeptide of the present disclosure is an LBD of a TRβ, the first member of the dimerization pair is an NCOA3/SRC3 polypeptide.

In some cases, where the first member of a dimerization pair of a conditionally active, heterodimeric polypeptide of the present disclosure is an LBD of a TRβ, the second member of the dimerization pair is an NCOA2/SRC2 polypeptide. For example, in some cases, where the first member of a dimerization pair of a conditionally active, heterodimeric polypeptide of the present disclosure is an LBD of a TRβ, the second member of the dimerization pair is a co-regulator peptide comprises the amino acid sequence STAPGSEVTIKQEPVSPKKKENALLRYLLDKDDTK-DIGLPEITPKLERLDSKTDPASNTKLIAMKT EKEEMS-FEPGDQPGSELDNLEEILDDLQNSQLPQLFPDTRPGA-PAGSVDKQAIINDLMQLTAENS PVTPVGAQKTALRISQSTFNNPRPGQL-GRLLPNQNLPLDITLQSPTGAGPFPPIRN-SSPYSVIPQPG MMGNQGMIGNQGNLGNSSTGMIGN-SASRPTMPSGEWAPQSSAVRVTCAATTSAMNRPVQ-GG MIRNPAASIPMRPSSQPGQRQTLQSQVM-NIGPSELEMNMGGP (SEQ ID NO:663). In some cases, where the second member of a dimerization pair of a conditionally active, heterodimeric polypeptide of the present disclosure is an LBD of a TRβ, the first member of the dimerization pair is an NCOA2/SRC2 polypeptide.

Estrogen Receptor-Alpha

In some cases, an LBD suitable for inclusion as a member of a dimerization pair of a conditionally active, heterodimeric polypeptide of the present disclosure is an LBD of estrogen receptor-alpha (ERα). For example, in some cases, the LBD comprises an amino acid sequence having at least 75%, at least 80%, at least 85%, at least 90%, at least 95%, at least 98%, at least 99%, or 100%, amino acid sequence identity to the LBD of an ERα having the amino acid sequence depicted in FIG. 5A.

As one non-limiting example, the LBD of an ERα can comprise an amino acid sequence having at least 75%, at least 80%, at least 85%, at least 90%, at least 95%, at least 98%, at least 99%, or 100%, amino acid sequence identity to an amino acid sequence depicted in FIG. 5H; and has a length of from about 200 amino acids to 240 amino acids (e.g., has a length of from 200 amino acids to 225 amino acids, from 225 amino acids to 230 amino acids, from 230 amino acids to 235 amino acids, or from 235 amino acids to 240 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5B; and has a length of from about 180 amino acids to 229 amino acids (e.g., has a length of from 180 amino acids to 200 amino acids, or from 200 amino acids to 229 amino acids; e.g., has a length of 229 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5C; and has a length of from about 250 amino acids to 314 amino acids (e.g., has a length of from 250 amino acids to 275 amino acids, from 275 amino acids to 300 amino acids, or from 300 amino acids to 314 amino acids; e.g., has a length of 314 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5D; and has a length of from about 190 amino acids to 238 amino acids (e.g., has a length of from 190 amino acids to 220 amino acids, or from 220 amino acids to 238 amino acids; e.g., has a length of 238 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5E, and has a D351Y substitution (where the amino acid numbering is based on the amino acid sequence depicted in FIG. 5A); and has a length of from about 180 amino acids to 229 amino acids (e.g., has a length of from 180 amino acids to 200 amino acids, or from 200 amino acids to 229 amino acids; e.g., has a length of 229 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5F, and has a D351Y substitution (where the amino acid numbering is based on the amino acid sequence depicted in FIG. 5A); and has a length of from about 250 amino acids to 314 amino acids (e.g., has a length of from 250 amino acids to 275 amino acids, from 275 amino acids to 300 amino acids, or from 300 amino acids to 314 amino acids; e.g., has a length of 314 amino acids).

As one non-limiting example, the LBD of an ERα can comprise an amino acid sequence having at least 75%, at least 80%, at least 85%, at least 90%, at least 95%, at least 98%, at least 99%, or 100%, amino acid sequence identity to the amino acid sequence depicted in FIG. 5G, and has a D351Y substitution (where the amino acid numbering is based on the amino acid sequence depicted in FIG. 5A); and has a length of from about 190 amino acids to 238 amino acids (e.g., has a length of from 190 amino acids to 220 amino acids, or from 220 amino acids to 238 amino acids; e.g., has a length of 238 amino acids).

In some cases, where the first member of a dimerization pair of a conditionally active, heterodimeric polypeptide of the present disclosure is an LBD of an ERα, the second member of the dimerization pair is a co-regulator peptide comprising the amino acid sequence DAFQLRQLILR-GLQDD (SEQ ID NO:12), where the co-regulator peptide has a length of from about 16 amino acids to about 50 amino acids (e.g., the co-regulator peptide has a length of from 16 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERα, the first member of the dimerization pair is a co-regulator peptide comprising the amino acid sequence DAFQLRQLILRGLQDD (SEQ ID NO:12), where the co-regulator peptide has a length of from about from about 16 amino acids to about 50 amino acids (e.g., the co-regulator peptide has a length of from 16 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of an ERα, the second member of the dimerization pair is a co-regulator peptide comprising the amino acid sequence SPGSREWFKDMLS (SEQ ID NO:13), where the co-regulator peptide has a length of from about 13 amino acids to about 50 amino acids (e.g., the co-regulator peptide has a length of from 13 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERα, the first member of the dimerization pair is a co-regulator peptide comprising the amino acid sequence SPGSREWFKDMLS (SEQ ID NO:13), where the co-regulator peptide has a length of from about from about 13 amino acids to about 50 amino acids (e.g., the co-regulator peptide has a length of from 13 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Estrogen Receptor-Beta (ERβ)

In some cases, an LBD suitable for inclusion as a member of a dimerization pair of a conditionally active, heterodimeric polypeptide of the present disclosure is an LBD of estrogen receptor-alpha (ERβ). For example, in some cases, the LBD comprises an amino acid sequence having at least 75%, at least 80%, at least 85%, at least 90%, at least 95%, at least 98%, at least 99%, or 100%, amino acid sequence identity to the LBD of an ERβ having the amino acid sequence depicted in FIG. 6A.

As one non-limiting example, the LBD of an ERβ can comprise an amino acid sequence having at least 75%, at least 80%, at least 85%, at least 90%, at least 95%, at least 98%, at least 99%, or 100%, amino acid sequence identity to an amino acid sequence depicted in FIG. 6C; and has a length of from about 200 amino acids to 243 amino acids (e.g., has a length of from 200 amino acids to 225 amino acids, from 225 amino acids to 230 amino acids, from 230 amino acids to 235 amino acids, or from 235 amino acids to 243 amino acids).

As one non-limiting example, the LBD of an ERβ can comprise an amino acid sequence having at least 75%, at least 80%, at least 85%, at least 90%, at least 95%, at least 98%, at least 99%, or 100%, amino acid sequence identity to the amino acid sequence depicted in FIG. 6B; and has a length of from about 200 amino acids to 243 amino acids (e.g., has a length of from 200 amino acids to 225 amino acids, from 225 amino acids to 230 amino acids, from 230 amino acids to 235 amino acids, or from 235 amino acids to 243 amino acids).

In some cases, where the first member of a dimerization pair of a conditionally active, heterodimeric polypeptide of the present disclosure is an LBD of an ERβ, the second member of the dimerization pair is a co-regulator peptide comprising the amino acid sequence PRQGSILYSMLT-SAKQT (SEQ ID NO:9), where the co-regulator peptide has a length of from about 17 amino acids to about 50 amino acids (e.g., the co-regulator peptide has a length of from 17 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of an ERβ, the first member of the dimerization pair is a co-regulator peptide comprising the amino acid sequence PRQGSILYSMLTSAKQT (SEQ ID NO:9), where the co-regulator peptide has a length of from about from about 17 amino acids to about 50 amino acids (e.g., the co-regulator peptide has a length of from 17 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Peroxisome Proliferator-Activated Receptor-Gamma

In some cases, an LBD suitable for inclusion as a member of a dimerization pair of a conditionally active, heterodimeric polypeptide of the present disclosure is an LBD of peroxisome proliferator-activated receptor-gamma (PPAR-γ). For example, in some cases, the LBD comprises an amino acid sequence having at least 75%, at least 80%, at least 85%, at least 90%, at least 95%, at least 98%, at least 99%, or 100%, amino acid sequence identity to the LBD of a PPAR-γ having the amino acid sequence depicted in FIG. 7A.

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 7E; and has a length of from about 200 amino acids to 269 amino acids (e.g., has a length of from 200 amino acids to 225 amino acids, from 225 amino acids to 250 amino acids, or from 250 amino acids to 269 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7B; and has a length of from about 150 amino acids to 202 amino acids (e.g., has a length of from 150 amino acids to 160 amino acids, from 160 amino acids to 170 amino acids, from 170 amino acids to 190 amino acids, or from 190 amino acids to 202 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7C; and has a length of from about 200 amino acids to 269 amino acids (e.g., has a length of from 200 amino acids to 225 amino acids, from 225 amino acids to 250 amino acids, or from 250 amino acids to 269 amino acids).

As one non-limiting example, the LBD of a PPAR-γ can comprise an amino acid sequence having at least 75%, at least 80%, at least 85%, at least 90%, at least 95%, at least 98%, at least 99%, or 100%, amino acid sequence identity to the amino acid sequence depicted in FIG. 7D; and has a length of from about 200 amino acids to 269 amino acids (e.g., has a length of from 200 amino acids to 225 amino acids, from 225 amino acids to 250 amino acids, or from 250 amino acids to 271 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence CPSSHSSLTERH-KILHRLLQEGSPS (SEQ ID NO:1), where the co-regulator peptide has a length of from about 25 amino acids to about 50 amino acids (e.g., the co-regulator peptide has a length of from 25 amino acids to 28 amino acids, from 28 amino acids to 29 amino acids, from 29 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence CPSSHSSLTERH-KILHRLLQEGSPS (SEQ ID NO:1), where the co-regulator peptide has a length of from about from about 17 amino acids to about 50 amino acids (e.g., the co-regulator peptide has a length of from about 25 amino acids to about 50 amino acids (e.g., the co-regulator peptide has a length of from 25 amino acids to 28 amino acids, from 28 amino acids to 29 amino acids, from 29 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence PKKENNALLRYLL-DRDDPSDV (SEQ ID NO:4), where the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence PKKENNALLRYLLDRDDPSDV (SEQ ID NO:4), where the co-regulator peptide has a length of from about from about 17 amino acids to about 50 amino acids (e.g., the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

In some cases, where the first member of a dimerization pair of a conditionally active, heterodimeric polypeptide of the present disclosure is an LBD of a PPAR-γ, the second member of the dimerization pair is a co-regulator peptide comprising the amino acid sequence PKKKENALLRYLL-DKDDTKDI (SEQ ID NO:11), where the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a PPAR-γ, the first member of the dimerization pair is a co-regulator peptide comprising the amino acid sequence PKKKENALLRYLLDKDDTKDI (SEQ ID NO:11), where the co-regulator peptide has a length of from about from about 21 amino acids to about 50 amino acids (e.g., the co-regulator peptide has a length of from about 21 amino acids to about 50 amino acids (e.g., the co-regulator peptide has a length of from 21 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids).

Glucocorticoid Receptor

In some cases, an LBD suitable for inclusion as a member of a dimerization pair of a conditionally active, heterodimeric polypeptide of the present disclosure is an LBD of glucocorticoid receptor (GR). For example, in some cases, the LBD comprises an amino acid sequence having at least 75%, at least 80%, at least 85%, at least 90%, at least 95%, at least 98%, at least 99%, or 100%, amino acid sequence identity to the LBD of a GR having the amino acid sequence depicted in FIG. 8A.

As one non-limiting example, the LBD of a GR can comprise an amino acid sequence having at least 75%, at least 80%, at least 85%, at least 90%, at least 95%, at least 98%, at least 99%, or 100%, amino acid sequence identity to one of the amino acid sequences depicted in FIG. 8C; and has a length of from about 200 amino acids to 247 amino acids (e.g., has a length of from 200 amino acids to 225 amino acids, from 225 amino acids to 230 amino acids, from 230 amino acids to 240 amino acids, or from 240 amino acids to 247 amino acids).

As one non-limiting example, the LBD of a GR can comprise an amino acid sequence having at least 75%, at least 80%, at least 85%, at least 90%, at least 95%, at least 98%, at least 99%, or 100%, amino acid sequence identity to the amino acid sequence depicted in FIG. 8B; and has a length of from about 200 amino acids to 247 amino acids (e.g., has a length of from 200 amino acids to 225 amino acids, or from 225 amino acids to 247 amino acids; e.g., has a length of 247 amino acids).

In some cases, where the first member of a dimerization pair of a conditionally active, heterodimeric polypeptide of the present disclosure is an LBD of a GR, the second member of the dimerization pair is an NCOA1/SRC1 polypeptide. For example, in some cases, where the first member of a dimerization pair of a conditionally active, heterodimeric polypeptide of the present disclosure is an LBD of a GR, the second member of the dimerization pair is an NCOA1/SRC1 polypeptide comprising the amino acid sequence NYGTNPGTPPASTSPFSQLAANPEASLANRN-SMVSRGMTGNIGGQFGTGINPQMQQNVFQYPG AGMVPQGEANFAPSL-SPGSSMVPMPIPPPQSSLLQQTP-PASGYQSPDMKAWQQGAIGNNNVFSQ AVQNQPT-PAQPGVYNNMSITVSMAGGNTNVQNMNPMMAQM-QMSSLQMPGMNTVCPEQIND PALRHTGLYCNQLSSTDLLK-TEADGTQQVQQVQVFAD-VQCTVNLVGGDPYLNQPGPLGTQKP TSGPQTPQAQQKSLLQQLLTE (SEQ ID NO:664) or a fragment thereof. In some cases, where the second member of a dimerization pair of a conditionally active, heterodimeric polypeptide of the present disclosure is an LBD of a GR, the first member of the dimerization pair is an NCOA1/SRC1 polypeptide.

In some cases, where the first member of a dimerization pair of a conditionally active, heterodimeric polypeptide of the present disclosure is an LBD of a GR, the second member of the dimerization pair is an NCOA2/SRC2 polypeptide. For example, in some cases, where the first member of a dimerization pair of a conditionally active, heterodimeric polypeptide of the present disclosure is an LBD of a GR, the second member of the dimerization pair is an NCOA2/SRC2 polypeptide comprising the amino acid sequence KRHHHEVLRQGLAFSQIYRFSLSDGTLVAAQTKSK-LIRSQTTNEPQLVISLHMLHREQNVCVMN PDLTGQTMGKPLNPISSNSPAHQAL-CSGNPGQDMTLSSN-INFPINGPKEQMGMPMGRFGGSGG MNHVSGMQAT-TPQGSNYALKMNSPSQSSPGMNPGQPTSMLSPRHR-MSPGVAGSPRIPPSQFSPA GSLHSPVGVCSSTGNSH-SYTNSSLNALQALSEGHGVSLGSSLASPDLKMGNL-QNSPVNMNPPPL SKMGSLDSKDCFGLY-GEPSEGTTGQAESSCHPGEQKETNDPNLPPAVSSE-RADGQSRLHDSKGQ TKLLQLLTTKSDQMEPSPLASSLSDTNKD-STGSLPGSGSTHGTSLKEKHKILHRLLQDSSSPVDL AKLTAEATGKDLSQESSSTAPGSEV-TIKQEPVSPKKKENALLRYLLDKDDTKDIGL-PEITPKLERL DSKTDPASNTKLIAMKTEKEEMS-FEPGDQPGSELDNLEEILDDLQNSQLPQLFPDTRPGA-PAGSV DKQAIINDLMQLTAENSPVTPVGAQKTAL-RISQSTFNNPRPGQLGRLLPNQNLPLDITLQSPTGA GPFPPIRNSSPYSVIPQPGMMGNQG-MIGNQGNLGNSSTGMIGNSASRPTMPSGEWAPQS-SAVRV TCAATTSAMNRPVQGGMIRNPAA-SIPMRPSSQPGQRQTLQSQVMNIGPSELEMNMGGP (SEQ ID NO:665) or a fragment thereof. In some cases, where the second member of a dimerization pair of a conditionally active, heterodimeric polypeptide of the present disclosure is an LBD of a GR, the first member of the dimerization pair is an NCOA2/SRC2 polypeptide.

Vitamin D Receptor

In some cases, an LBD suitable for inclusion as a member of a dimerization pair of a conditionally active, heterodimeric polypeptide of the present disclosure is an LBD of vitamin D receptor (VDR). For example, in some cases, the LBD comprises an amino acid sequence having at least 75%, at least 80%, at least 85%, at least 90%, at least 95%, at least 98%, at least 99%, or 100%, amino acid sequence identity to the LBD of a VDR having the amino acid sequence depicted in FIG. 9A.

As one non-limiting example, the LBD of a VDR can comprise an amino acid sequence having at least 75%, at least 80%, at least 85%, at least 90%, at least 95%, at least 98%, at least 99%, or 100%, amino acid sequence identity to one of the amino acid sequences depicted in FIG. 9C; and has a length of from about 250 amino acids to 310 amino acids (e.g., has a length of from 250 amino acids to 275 amino acids, from 275 amino acids to 300 amino acids, or from 300 amino acids to 310 amino acids).

As one non-limiting example, the LBD of a VDR can comprise an amino acid sequence having at least 75%, at least 80%, at least 85%, at least 90%, at least 95%, at least 98%, at least 99%, or 100%, amino acid sequence identity to the amino acid sequence depicted in FIG. 9B; and has a length of from about 250 amino acids to 303 amino acids (e.g., has a length of from 250 amino acids to 275 amino acids, from 275 amino acids to 300 amino acids, or from 300 amino acids to 303 amino acids).

In some cases, where the first member of a dimerization pair of a conditionally active, heterodimeric polypeptide of the present disclosure is an LBD of a VDR, the second member of the dimerization pair is an NCOA1/SRC1 polypeptide. For example, in some cases, where the first member of a dimerization pair of a conditionally active, heterodimeric polypeptide of the present disclosure is an LBD of a VDR, the second member of the dimerization pair is an NCOA1/SRC1 polypeptide comprising the amino acid sequence NYGTNPGTPPASTSPFSQLAANPEASLANRN-SMVSRGMTGNIGGQFGTGINPQMQQNVFQYPG AGMVPQGEANFAPSL-SPGSSMVPMPIPPPQSSLLQQTP-PASGYQSPDMKAWQQGAIGNNNVFSQ AVQNQPT-PAQPGVYNNMSITVSMAGGNTNVQNMNPMMAQM-QMSSLQMPGMNTVCPEQIND PALRHTGLYCNQLSSTDLLK-TEADGTQQVQQVQVFAD-VQCTVNLVGGDPYLNQPGPLGTQKP TSGPQTPQAQQKSLLQQLLTE (SEQ ID NO:666) or a fragment thereof. In some cases, where the second member of a dimerization pair of a conditionally active, heterodimeric polypeptide of the present disclosure is an LBD of a VDR, the first member of the dimerization pair is an NCOA1/SRC1 polypeptide.

In some cases, where the first member of a dimerization pair of a conditionally active, heterodimeric polypeptide of the present disclosure is an LBD of a VDR, the second member of the dimerization pair is an NCOA2/SRC2 polypeptide. For example, in some cases, where the first member of a dimerization pair of a conditionally active, heterodimeric polypeptide of the present disclosure is an LBD of a VDR, the second member of the dimerization pair is an NCOA2/SRC2 polypeptide comprising the amino acid sequence KRHHHEVLRQGLAFSQIYRFSLSDGTLVAAQTKSK-LIRSQTTNEPQLVISLHMLHREQNVCVMN PDLTGQTMGKPLNPISSNSPAHQAL-CSGNPGQDMTLSSN-INFPINGPKEQMGMPMGRFGGSGG MNHVSGMQAT- TPQGSNYALKMNSPSQSSPGMNPGQPTSMLSPRHR-MSPGVAGSPRIPPSQFSPA GSLHSPVGVCSSTGNSH-SYTNSSLNALQALSEGHGVSLGSSLASPDLKMGNL-QNSPVNMNPPPL SKMGSLDSKDCFGLY-GEPSEGTTGQAESSCHPGEQKETNDPNLPPAVSSE-RADGQSRLHDSKGQ TKLLQLLTTKSDQMEPSPLASSLSDTNKD-STGSLPGSGSTHGTSLKEKHKILHRLLQDSSSPVDL AKLTAEATGKDLSQESSSTAPGSEV-TIKQEPVSPKKKENALLRYLLDKDDTKDIGL-PEITPKLERL DSKTDPASNTKLIAMKTEKEEMS-FEPGDQPGSELDNLEEILDDLQNSQLPQLFPDTRPGA-PAGSV DKQAIINDLMQLTAENSPVTPVGAQKTAL-RISQSTFNNPRPGQLGRLLPNQNLPLDITLQSPTGA GPFPPIRNSSPYSVIPQPGMMGNQG-MIGNQGNLGNSSTGMIGNSASRPTMPSGEWAPQS-SAVRV TCAATTSAMNRPVQGGMIRNPAA-SIPMRPSSQPGQRQTLQSQVMNIGPSELEMNMGGP (SEQ ID NO:667) or a fragment thereof. For example, in some cases, where the first member of a dimerization pair of a conditionally active, heterodimeric polypeptide of the present disclosure is an LBD of a VDR, the second member of the dimerization pair is an NCOA2/SRC2 polypeptide comprising the amino acid sequence LLRYLLDK (SEQ ID NO:668), where the co-regulator peptide has a length of from about from about 8 amino acids to about 50 amino acids (e.g., the co-regulator peptide has a length of from about 8 amino acids to 10 amino acids, from 10 amino acids to 15 amino acids, from 15 amino acids to 20 amino acids, from 20 amino acids to 23 amino acids, from 23 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids). In some cases, where the second member of a dimerization pair of a conditionally active, heterodimeric polypeptide of the present disclosure is an LBD of a VDR, the first member of the dimerization pair is an NCOA2/SRC2 polypeptide.

Thyroid Hormone Receptor-Alpha

In some cases, an LBD suitable for inclusion as a member of a dimerization pair of a conditionally active, heterodimeric polypeptide of the present disclosure is an LBD of thyroid hormone receptor-alpha (TRα). For example, in some cases, the LBD comprises an amino acid sequence having at least 75%, at least 80%, at least 85%, at least 90%, at least 95%, at least 98%, at least 99%, or 100%, amino acid sequence identity to the LBD of a TRα having the amino acid sequence depicted in FIG. 10A.

As one non-limiting example, the LBD of a TRα can comprise an amino acid sequence having at least 75%, at least 80%, at least 85%, at least 90%, at least 95%, at least 98%, at least 99%, or 100%, amino acid sequence identity to one of the amino acid sequences depicted in FIG. 10C; and has a length of from about 190 amino acids to about 245 amino acids (e.g., has a length of from 190 amino acids to 210 amino acids, from 210 amino acids to 230 amino acids, or from 230 amino acids to 245 amino acids).

As one non-limiting example, the LBD of a TRα can comprise an amino acid sequence having at least 75%, at least 80%, at least 85%, at least 90%, at least 95%, at least 98%, at least 99%, or 100%, amino acid sequence identity to the amino acid sequence depicted in FIG. 10B; and has a length of from about 190 amino acids to about 243 amino acids (e.g., has a length of from 190 amino acids to 210 amino acids, from 210 amino acids to 230 amino acids, or from 230 amino acids to 243 amino acids).

Retinoic Acid Receptor-Beta

In some cases, an LBD suitable for inclusion as a member of a dimerization pair of a conditionally active, heterodimeric polypeptide of the present disclosure is an LBD of retinoic acid receptor-beta (RARβ). For example, in some cases, the LBD comprises an amino acid sequence having at least 75%, at least 80%, at least 85%, at least 90%, at least 95%, at least 98%, at least 99%, or 100%, amino acid sequence identity to the LBD of a RARβ having the amino acid sequence depicted in FIG. 11A.

As one non-limiting example, the LBD of a RARβ can comprise an amino acid sequence having at least 75%, at least 80%, at least 85%, at least 90%, at least 95%, at least 98%, at least 99%, or 100%, amino acid sequence identity to one of the amino acid sequences depicted in FIG. 11C; and has a length of from about 180 amino acids to about 235 amino acids (e.g., has a length of from 180 amino acids to 200 amino acids, from 200 amino acids to 220 amino acids, or from 220 amino acids to 235 amino acids).

As one non-limiting example, the LBD of a RARβ can comprise an amino acid sequence having at least 75%, at least 80%, at least 85%, at least 90%, at least 95%, at least 98%, at least 99%, or 100%, amino acid sequence identity to the amino acid sequence depicted in FIG. 11B; and has a length of from about 180 amino acids to about 231 amino acids (e.g., has a length of from 180 amino acids to 200 amino acids, from 200 amino acids to 220 amino acids, or from 220 amino acids to 231 amino acids).

A suitable co-regulator peptide for a RARβ is an SRC1 polypeptide, or a fragment thereof (e.g., a peptide of from 8 amino acids to 50 amino acids in length, derived from an SRC1 polypeptide).

Farnesoid X Receptor

In some cases, an LBD suitable for inclusion as a member of a dimerization pair of a conditionally active, heterodimeric polypeptide of the present disclosure is an LBD of farnesoid X receptor (FXR. For example, in some cases, the LBD comprises an amino acid sequence having at least 75%, at least 80%, at least 85%, at least 90%, at least 95%, at least 98%, at least 99%, or 100%, amino acid sequence identity to the LBD of an FXR having the amino acid sequence depicted in FIG. 22A.

As one non-limiting example, the LBD of an FXR can comprise an amino acid sequence having at least 75%, at least 80%, at least 85%, at least 90%, at least 95%, at least 98%, at least 99%, or 100%, amino acid sequence identity to the amino acid sequence depicted in FIG. 22B; and has a length of from about 100 amino acids to about 136 amino acids (e.g., has a length of from 100 amino acids to 110 amino acids, from 110 amino acids to 120 amino acids, or from 120 amino acids to 136 amino acids).

A suitable co-regulator peptide for an FXR is an SRC1 polypeptide, or a fragment thereof (e.g., a peptide of from 8 amino acids to 50 amino acids in length, derived from an SRC1 polypeptide).

LXR-Alpha

In some cases, an LBD suitable for inclusion as a member of a dimerization pair of a conditionally active, heterodimeric polypeptide of the present disclosure is an LBD of liver X receptor-alpha (LRXα). For example, in some cases, the LBD comprises an amino acid sequence having at least 75%, at least 80%, at least 85%, at least 90%, at least 95%, at least 98%, at least 99%, or 100%, amino acid sequence identity to the LBD of an LRXα having the amino acid sequence depicted in FIG. 23A.

As one non-limiting example, the LBD of an LRXα can comprise an amino acid sequence having at least 75%, at least 80%, at least 85%, at least 90%, at least 95%, at least 98%, at least 99%, or 100%, amino acid sequence identity to the amino acid sequence depicted in FIG. 23B; and has a length of from about 200 amino acids to about 266 amino acids (e.g., has a length of from 200 amino acids to 220 amino acids, from 220 amino acids to 240 amino acids, or from 240 amino acids to 266 amino acids).

A suitable co-regulator peptide for an LXRα is an SRC1 polypeptide, or a fragment thereof (e.g., a peptide of from 8 amino acids to 50 amino acids in length, derived from an SRC1 polypeptide).

RORgamma

In some cases, an LBD suitable for inclusion as a member of a dimerization pair of a conditionally active, heterodimeric polypeptide of the present disclosure is an LBD of a retinoid-related orphan receptor gamma (RORγ). For example, in some cases, the LBD comprises an amino acid sequence having at least 75%, at least 80%, at least 85%, at least 90%, at least 95%, at least 98%, at least 99%, or 100%, amino acid sequence identity to the LBD of an RORγ having the amino acid sequence depicted in FIG. 24A.

As one non-limiting example, the LBD of an RORγ can comprise an amino acid sequence having at least 75%, at least 80%, at least 85%, at least 90%, at least 95%, at least 98%, at least 99%, or 100%, amino acid sequence identity to the amino acid sequence depicted in FIG. 24B; and has a length of from about 200 amino acids to about 261 amino acids (e.g., has a length of from 200 amino acids to 220 amino acids, from 220 amino acids to 240 amino acids, or from 240 amino acids to 261 amino acids).

A suitable co-regulator for an RORγ is an NCORNR peptide (CDPASNLGLEDIIRKALMGSFDDK, SEQ ID NO:669).

A suitable co-regulator peptide for an RORγ is an SRC1 polypeptide, or a fragment thereof (e.g., a peptide of from 8 amino acids to 50 amino acids in length, derived from an SRC1 polypeptide).

RXR-Alpha

In some cases, an LBD suitable for inclusion as a member of a dimerization pair of a conditionally active, heterodimeric polypeptide of the present disclosure is an LBD of a retinoid-X receptor-alpha (RXRα). For example, in some cases, the LBD comprises an amino acid sequence having at least 75%, at least 80%, at least 85%, at least 90%, at least 95%, at least 98%, at least 99%, or 100%, amino acid sequence identity to the LBD of an RXRα having the amino acid sequence depicted in FIG. 25A.

As one non-limiting example, the LBD of an RORγ can comprise an amino acid sequence having at least 75%, at least 80%, at least 85%, at least 90%, at least 95%, at least 98%, at least 99%, or 100%, amino acid sequence identity to the amino acid sequence depicted in FIG. 25B; and has a length of from about 190 amino acids to about 238 amino acids (e.g., has a length of from 190 amino acids to 200 amino acids, from 200 amino acids to 210 amino acids, or from 210 amino acids to 238 amino acids).

A suitable co-regulator peptide for an RXRα is an SRC1 polypeptide, or a fragment thereof (e.g., a peptide of from 8 amino acids to 50 amino acids in length, derived from an SRC1 polypeptide).

PXR

In some cases, an LBD suitable for inclusion as a member of a dimerization pair of a conditionally active, heterodimeric polypeptide of the present disclosure is an LBD of a Pregnane X Receptor (PXR). For example, in some cases, the LBD comprises an amino acid sequence having at least 75%, at least 80%, at least 85%, at least 90%, at least 95%, at least 98%, at least 99%, or 100%, amino acid sequence identity to the LBD of a PXR having the amino acid sequence depicted in FIG. 26A. In some cases, the LBD comprises an amino acid sequence having at least 75%, at least 80%, at least 85%, at least 90%, at least 95%, at least 98%, at least 99%, or 100%, amino acid sequence identity to amino acids 143-428 of the amino acid sequence depicted in FIG. 26A. In some cases, the LBD comprises an amino acid sequence having at least 75%, at least 80%, at least 85%, at least 90%, at least 95%, at least 98%, at least 99%, or 100%, amino acid sequence identity to amino acids 205-434 of the amino acid sequence depicted in FIG. 26A.

As one non-limiting example, the LBD of a PXR can comprise an amino acid sequence having at least 75%, at least 80%, at least 85%, at least 90%, at least 95%, at least 98%, at least 99%, or 100%, amino acid sequence identity to the amino acid sequence depicted in FIG. 26B; and has a length of from about 250 amino acids to about 302 amino acids (e.g., has a length of from 250 amino acids to 275 amino acids, from 275 amino acids to 290 amino acids, or from 290 amino acids to 302 amino acids).

A suitable co-regulator peptide for a PXR is an SRC1 polypeptide, or a fragment thereof (e.g., a peptide of from 8 amino acids to 50 amino acids in length, derived from an SRC1 polypeptide).

Co-Regulator Peptides

Suitable co-regulator polypeptides include full-length naturally-occurring nuclear hormone co-regulator polypeptides. Suitable co-regulator polypeptides include fragments of naturally-occurring nuclear hormone co-regulator polypeptides. Suitable co-regulator polypeptides include synthetic or recombinant nuclear hormone co-regulator polypeptides.

Suitable co-regulator polypeptides can have a length of from 8 amino acids to 2000 amino acids. Suitable co-regulator polypeptides can have a length of from 8 amino acids to 50 amino acids, e.g., from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids. Suitable co-regulator polypeptides can have a length of from 50 amino acids to 100 amino acids, e.g., from 50 amino acids to 60 amino acids, from 60 amino acids to 70 amino acids, from 70 amino acids to 80 amino acids, from 80 amino acids to 90 amino acids, or from 90 amino acids to 100 amino acids. Suitable co-regulator polypeptides can have a length of from 100 amino acids to 200 amino acids, from 200 amino acids to 300 amino acids, from 300 amino acids to 400 amino acids, from 400 amino acids to 500 amino acids, from 500 amino acids to 600 amino acids, from 600 amino acids to 700 amino acids, from 700 amino acids to 800 amino acids, from 800 amino acids to 900 amino acids, or from 900 amino acids to 1000 amino acids. Suitable co-regulator polypeptides can have a length of from 1000 amino acids to 2000 amino acids.

Suitable co-regulator polypeptides include, but are not limited to, SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

National Center for Biotechnology Information (NCBI) accession numbers for such co-regulators include the following: SRC1 (NP_003734), GRIP1 (NP_006531), AIB1 (NP_006525), PGC1a (NP_037393), PGC1b (NP_573570), PRC (NP_055877), TRAP220 (NP_004765), ASC2

(NP_054790), CBP (NP_004371), P300 (NP_001420), CIA (NP_066018), ARA70 (NP_005428), TIF1 (NP_003843), NSD1 (NP_071900), SMAP (NP_006687), Tip60 (NP_006379), ERAP140 (NP_861447), Nix1 (NP_113662), LCoR (NP_115816), N-CoR (NP_006302), SMRT (NP_006303), RIP140 (NP_003480) and PRIC285 (NP_208384).

Examples of suitable co-regulator polypeptides are provided in FIGS. 29-51B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 29.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 30.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 31.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 32.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 33.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 34.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 35.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 36A-36B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 37A-37B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 36A-36B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 39.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 40.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 41.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 42A-42B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 43.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 44.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 45.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 46.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 47.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 48A-48B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 49A-49B.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 50.

In some cases, a suitable suitable co-regulator polypeptide has a length of from 8 amino acids to 10 amino acids, from 10 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids; and has at least 75%, at least 80%, at least 85%, at least 90%, at least 95%, at least 98%, at least 99%, or 100%, amino acid sequence identity to a stretch of from 8 to 50 contiguous amino acids of the amino acid sequence depicted in FIG. 51A-51B.

Suitable co-regulator peptides include, but are not limited to, Steroid Receptor Coactivator (SRC)-1, SRC-2, SRC-3, TRAP220-1, TRAP220-2, NR0B1, NRIP1, CoRNR box, abV, TIF1, TIF2, EA2, TA1, EAB1, SRC1-1, SRC1-2, SRC1-3, SRC1-4a, SRC1-4b, GRIP1-1, GRIP1-2, GRIP1-3, AIB1-1, AIB1-2, AIB1-3, PGC1a, PGC1b, PRC, ASC2-1, ASC2-2, CBP-1, CBP-2, P300, CIA, ARA70-1, ARA70-2, NSD1, SMAP, Tip60, ERAP140, Nix1, LCoR, CoRNR1 (N-CoR), CoRNR2, SMRT, RIP140-C, RIP140-1, RIP140-2, RIP140-3, RIP140-4, RIP140-5, RIP140-6, RIP140-7, RIP140-8, RIP140-9, PRIC285-1, PRIC285-2, PRIC285-3, PRIC285-4, and PRIC285-5.

National Center for Biotechnology Information (NCBI) accession numbers for such co-regulators include the following: SRC1 (NP_003734), GRIP1 (NP_006531), AIB1 (NP_006525), PGC1a (NP_037393), PGC1b (NP_573570), PRC (NP_055877), TRAP220 (NP_004765), ASC2 (NP_054790), CBP (NP_004371), P300 (NP_001420), CIA (NP_066018), ARA70 (NP_005428), TIF1 (NP_003843), NSD1 (NP_071900), SMAP (NP_006687), Tip60 (NP_006379), ERAP140 (NP_861447), Nix1 (NP_113662), LCoR (NP_115816), N-CoR (NP_006302), SMRT (NP_006303), RIP140 (NP_003480) and PRIC285 (NP_208384).

In some cases, a suitable co-regulator peptide comprises an LXXLL motif, where X is any amino acid; where the co-regulator peptide has a length of from 12 amino acids to 50 amino acids, e.g., from 12 amino acids to 15 amino acids, from 15 amino acids to 20 amino acids, from 20 amino acids to 25 amino acids, from 25 amino acids to 30 amino acids, from 30 amino acids to 35 amino acids, from 35 amino acids to 40 amino acids, from 40 amino acids to 45 amino acids, or from 45 amino acids to 50 amino acids.

Non-limiting examples of suitable co-regulator peptides are as follows:

```
SRC1:
                                         (SEQ ID NO: 1)
CPSSHSSLTERHKILHRLLQEGSPS;

SRC1-2:
                                         (SEQ ID NO: 2)
SLTARHKILHRLLQEGSPSDI;

SRC3-1:
                                         (SEQ ID NO: 3)
ESKGHKKLLQLLTCSSDDR;

SRC3:
                                         (SEQ ID NO: 4)
PKKENNALLRYLLDRDDPSDV;

PGC-1:
                                         (SEQ ID NO: 5)
AEEPSLLKKLLLLAPANT;

PGC1a:
                                         (SEQ ID NO: 6)
QEAEEPSLLKKLLLLAPANTQL;

TRAP220-1:
                                         (SEQ ID NO: 7)
SKVSQNPILTSLLQITGNGGS;

NCoR (2051-2075):
                                         (SEQ ID NO: 8)
GHSFADPASNLGLEDIIRKALMGSF;

NR0B1:
                                         (SEQ ID NO: 9)
PRQGSILYSMLTSAKQT;

NRIP1:
                                         (SEQ ID NO: 10)
AANNSLLLHLLKSQTIP;

TIF2:
                                         (SEQ ID NO: 11)
PKKKENALLRYLLDKDDTKDI;

CoRNR Box:
                                         (SEQ ID NO: 12)
DAFQLRQLILRGLQDD;

abV:
                                         (SEQ ID NO: 13)
SPGSREWFKDMLS;

TRAP220-2:
                                         (SEQ ID NO: 14)
GNTKNHPMLMNLLKDNPAQDF;

EA2:
                                         (SEQ ID NO: 15)
SSKGVLWRMLAEPVSR;

TA1:
                                         (SEQ ID NO: 16)
SRTLQLDWGTLYWSR;

EAB1:
                                         (SEQ ID NO: 17)
SSNHQSSRLIELLSR;

SRC2:
                                         (SEQ ID NO: 18)
LKEKHKILHRLLQDSSSPV;

SRC1-3:
                                         (SEQ ID NO: 19)
QAQQKSLLQQLLTE;

SRC1-1:
                                         (SEQ ID NO: 20)
KYSQTSHKLVQLLTTTAEQQL;

SRC1-2:
                                         (SEQ ID NO: 21)
SLTARHKILHRLLQEGSPSDI;

SRC1-3:
                                         (SEQ ID NO: 22)
KESKDHQLLRYLLDKDEKDLR;

SRC1-4a:
                                         (SEQ ID NO: 23)
PQAQQKSLLQQLLTE;

SRC1-4b:
                                         (SEQ ID NO: 24)
PQAQQKSLRQQLLTE;
```

GRIP1-1:
(SEQ ID NO: 25)
HDSKGQTKLLQLLTTKSDQME;

GRIP1-2:
(SEQ ID NO: 26)
SLKEKHKILHRLLQDSSSPVD;

GRIP1-3:
(SEQ ID NO: 27)
PKKKENALLRYLLDKDDTKDI;

AIB1-1:
(SEQ ID NO: 28)
LESKGHKKLLQLLTCSSDDRG;

AIB1-2:
(SEQ ID NO: 29)
LLQEKHRILHKLLQNGNSPAE;

AIB1-3:
(SEQ ID NO: 30)
KKKENNALLRYLLDRDDPSDA;

PGC1a:
(SEQ ID NO: 31)
QEAEEPSLLKKLLLAPANTQL;

PGC1b:
(SEQ ID NO: 32)
PEVDELSLLQKLLLATSYPTS;

PRC:
(SEQ ID NO: 33)
VSPREGSSLHKLLTLSRTPPE;

TRAP220-1:
(SEQ ID NO: 34)
SKVSQNPILTSLLQITGNGGS;

TRAP220-2:
(SEQ ID NO: 35)
GNTKNHPMLMNLLKDNPAQDF;

ASC2-1:
(SEQ ID NO: 36)
DVTLTSPLLVNLLQSDISAGH;

ASC2-2:
(SEQ ID NO: 37)
AMREAPTSLSQLLDNSGAPNV;

CBP-1:
(SEQ ID NO: 38)
DAASKHKQLSELLRGGSGSSI;

CBP-2:
(SEQ ID NO: 39)
KRKLIQQQLVLLLHAHKCQRR;

P300:
(SEQ ID NO: 40)
DAASKHKQLSELLRSGSSPNL;

CIA:
(SEQ ID NO: 41)
GHPPAIQSLINLLADNRYLTA;

ARA70-1:
(SEQ ID NO: 42)
TLQQQAQQLYSLLGQFNCLTH;

ARA70-2:
(SEQ ID NO: 43)
GSRETSEKFKLLFQSYNVNDW;

TIF1:
(SEQ ID NO: 44)
NANYPRSILTSLLLNSSQSST;

NSD1:
(SEQ ID NO: 45)
IPIEPDYKFSTLLMMLKDMHD;

SMAP:
(SEQ ID NO: 46)
ATPPPSPLLSELLKKGSLLPT;

Tip60:
(SEQ ID NO: 47)
VDGHERAMLKRLLRIDSKCLH;

ERAP140:
(SEQ ID NO: 48)
HEDLDKVKLIEYYLTKNKEGP;

Nix1:
(SEQ ID NO: 49)
ESPEFCLGLQTLLSLKCCIDL;

LCoR:
(SEQ ID NO: 50)
AATTQNPVLSKLLMADQDSPL;

CoRNR1 (N-CoR):
(SEQ ID NO: 51)
MGQVPRTHRLITLADHICQIITQDFARNQV;

CoRNR2 (N-CoR):
(SEQ ID NO: 52)
NLGLEDIIRKALMG;

CoRNR1 (SMRT):
(SEQ ID NO: 53)
APGVKGHQRVVTLAQHISEVITQDTYRHHPQQLSAPLPAP;

CoRNR2 (SMRT):
(SEQ ID NO: 54)
NMGLEAIIRKALMG;

RIP140-C:
(SEQ ID NO: 55)
RLTKTNPILYYMLQKGGNSVA;

RIP140-1:
(SEQ ID NO: 56)
QDSIVLTYLEGLLMHQAAGGS;

RIP140-2:
(SEQ ID NO: 57)
KGKQDSTLLASLLQSFSSRLQ;

RIP140-3:
(SEQ ID NO: 58)
CYGVASSHLKTLLKKSKVKDQ;

RIP140-4:
(SEQ ID NO: 59)
KPSVACSQLALLLSSEAHLQQ;

RIP140-5:
(SEQ ID NO: 60)
KQAANNSLLLHLLKSQTIPKP;

RIP140-6:
(SEQ ID NO: 61)
NSHQKVTLLQLLLGHKNEENV;

RIP140-7:
(SEQ ID NO: 62)
NLLERRTVLQLLLGNPTKGRV;

RIP140-8:
(SEQ ID NO: 63)
FSFSKNGLLSRLLRQNQDSYL;

RIP140-9:
(SEQ ID NO: 64)
RESKSFNVLKQLLLSENCVRD;

```
PRIC285-1:
                                          (SEQ ID NO: 65)
ELNADDAILRELLDESQKVMV;

PRIC285-2:
                                          (SEQ ID NO: 66)
YENLPPAALRKLLRAEPERYR;

PRIC285-3:
                                          (SEQ ID NO: 67)
MAFAGDEVLVQLLSGDKAPEG;

PRIC285-4:
                                          (SEQ ID NO: 68)
SCCYLCIRLEGLLAPTASPRP;
and PRIC285-5:
                                          (SEQ ID NO: 69)
PSNKSVDVLAGLLLRRMELKP.
```

In some cases, a given LBD can be paired with two or more different co-regulator polypeptides. For example, as depicted in FIG. 19, PPARγ can be paired with SRC1, SRC2, SRC3, or TRAP220. As another example, ERα can be paired with CoRNR, αβV, or TA1. As another example, ERβ can be paired with CoRNR, αβV, or TA1. As another example, AR can be paired with SRC1, SRC2, SRC3, or TRAP220. As another example, PR can be paired with SRC1, SRC2, SRC3, TRAP220, NR0B1, PGC1B, NRIP1, EA2, or EAB1. As another example, TRβ can be paired with SRC1, SRC2, SRC3, or TRAP220.

In some cases, a heterodimeric polypeptide of the present disclosure comprises a polypeptide chain comprising multiple (two or more) co-regulator peptides. Where a heterodimeric polypeptide of the present disclosure comprises a polypeptide chain comprising multiple (two or more) co-regulator peptides, the multiple co-regulator peptides can be in tandem, directly or separated by a linker. In some cases, the two or more co-regulator peptides present in the polypeptide chain are identical in amino acid sequence to one another. In some cases, where a heterodimeric polypeptide of the present disclosure comprises a polypeptide chain comprising multiple (two or more) co-regulator peptides, the polypeptide chain comprises two co-regulator peptides. In some cases, where a heterodimeric polypeptide of the present disclosure comprises a polypeptide chain comprising multiple (two or more) co-regulator peptides, the polypeptide chain comprises three co-regulator peptides. In such cases, the second polypeptide chain can comprise multiple (two or more) LBD of a nuclear hormone receptor. For example, where the second polypeptide chain comprises two LBD of a nuclear hormone receptor, the two LBD can be identical in amino acid sequence to one another.

Suitable dimerization agents are as described above.

Engineered T Cell Receptor (TCR)

In some instances, a heteromeric, conditionally repressible synthetic ICR may include, in part or in whole, an engineered T cell receptor (TCR) or may essentially be a modified engineered TCR such that by modification the engineered TCR is conditionally repressible. In such instances, the engineered TCR containing heteromeric, conditionally repressible synthetic ICR may be referred to as a heteromeric, conditionally repressible synthetic TCR or, for simplicity, a repressible TCR.

Any engineered TCR having immune cell activation function may find use in a heteromeric, conditionally repressible synthetic ICR as described herein including but not limited to, e.g., antigen-specific TCRs, Monoclonal TCRs (MTCRs), Single chain MTCRs, High Affinity CDR2 Mutant TCRs, CD1-binding MTCRs, High Affinity NY-ESO TCRs, VYG HLA-A24 Telomerase TCRs, including e.g., those described in PCT Pub Nos. WO 2003/020763, WO 2004/033685, WO 2004/044004, WO 2005/114215, WO 2006/000830, WO 2008/038002, WO 2008/039818, WO 2004/074322, WO 2005/113595, WO 2006/125962; Strommes et al. Immunol Rev. 2014; 257(1):145-64; Schmitt et al. Blood. 2013; 122(3):348-56; Chapuls et al. Sci Transl Med. 2013; 5(174):174ra27; Thaxton et al. Hum Vaccin Immunother. 2014; 10(11):3313-21 (PMID:25483644); Gschweng et al. Immunol Rev. 2014; 257(1):237-49 (PMID:24329801); Hinrichs et al. Immunol Rev. 2014; 257(1):56-71 (PMID:24329789); Zoete et al. Front Immunol. 2013; 4:268 (PMID:24062738); Marr et al. Clin Exp Immunol. 2012; 167(2):216-25 (PMID:22235997); Zhang et al. Adv Drug Deliv Rev. 2012; 64(8):756-62 (PMID:22178904); Chhabra et al. Scientific World Journal. 2011; 11:121-9 (PMID:21218269); Boulter et al. Clin Exp Immunol. 2005; 142(3):454-60 (PMID:16297157); Sami et al. Protein Eng Des Sel. 2007; 20(8):397-403; Boulter et al. Protein Eng. 2003; 16(9):707-11; Ashfield et al. IDrugs. 2006; 9(8):554-9; Li et al. Nat Biotechnol. 2005; 23(3):349-54; Dunn et al. Protein Sci. 2006; 15(4):710-21; Liddy et al. Mol Biotechnol. 2010; 45(2); Liddy et al. Nat Med. 2012; 18(6):980-7; Oates, et al. Oncoimmunology. 2013; 2(2):e22891; McCormack, et al. Cancer Immunol Immunother. 2013 April; 62(4):773-85; Bossi et al. Cancer Immunol Immunother. 2014; 63(5):437-48 and Oates, et al. Mol Immunol. 2015 October; 67(2 Pt A):67-74; the disclosures of which are incorporated herein by reference in their entirety.

In some instances, an engineered TCR useful in a heteromeric, conditionally repressible synthetic ICR as described herein may include, e.g., a NY-ESO-1-binding TCR or a TCR that binds to NY-ESO-1 or a peptide derived therefrom. For example, in some instances a NY-ESO-1-binding TCR may be an engineered TCR that binds to a peptide having the amino acid sequence: SLLMWITQC (SEQ ID NO:670).

In some instances, an engineered TCR useful in a heteromeric, conditionally repressible synthetic ICR as described herein may be or may be derived from an engineered TCR having high affinity for its ligand including but not limited to, e.g., a $K_D$ of less than or equal to 100 μM, including but not limited to e.g., a $K_D$ of less than or equal to 10 μM or a $K_D$ of less than or equal to 1 μM. In some instances, an engineered TCR useful in a heteromeric, conditionally repressible synthetic ICR as described herein may be or may be derived from an engineered TCR having high affinity for the peptide SLLMWITQC (SEQ ID NO:671), including but not limited to, e.g., a $K_D$ of less than or equal to 100 μM, including but not limited to e.g., a $K_D$ of less than or equal to 10 μM or a $K_D$ of less than or equal to 1 μM for the peptide SLLMWITQC (SEQ ID NO:672). The $K_D$ measurement can be made by any known method, including but not limited to e.g., Surface Plasmon Resonance (Biacore).

In some instances, an engineered TCR useful in a heteromeric, conditionally repressible synthetic ICR as described herein may be or may be derived from an engineered TCR having a slow off-rate ($k_{off}$) from its ligand including but not limited to, e.g., a $k_{off}$ of 0.1 $S^{-1}$ or slower, including but not limited to e.g., a $k_{off}$ of $1 \times 10^{-2}$ $S^{-1}$ or slower or a $k_{off}$ of $1 \times 10^{-3}$ $S^{-1}$ or slower. In some instances, an engineered TCR useful in a heteromeric, conditionally repressible synthetic ICR as described herein may be or may be derived from an engineered TCR having a slow off-rate from the peptide SLLMWITQC (SEQ ID NO:673), including but not limited to, e.g., a $K_D$ of less than or equal to 100 μM, including but not limited to e.g., a $k_{off}$ of 0.1 S$^{-1}$ or slower, including but not limited to e.g., a $k_{off}$ of 1×10$^{-2}$ S$^{-1}$ or slower or a $k_{off}$ of 1×10$^{-3}$ S$^{-1}$ or slower from the peptide SLLMWITQC (SEQ ID NO:674). The $k_{off}$ measurement can be made by any known method, including but not limited to e.g., Surface Plasmon Resonance (Biacore).

In some instances, an engineered TCR may be modified for use as a component of a heteromeric, conditionally repressible synthetic ICR through introduction or insertion of a dimerization domain (e.g., a member of a dimerizer pair) into the engineered TCR and, in such instances, following modification, the engineered TCR may be referred to as a dimerizer-domain containing TCR or a dimerizable TCR.

A dimerizer domain may be inserted into the engineered TCR amino acid sequence, e.g., by introducing a coding sequence for the dimerizer domain into the coding sequence of the engineered TCR, at any convenient location provided the insertion does not negatively impact the primary functional domains of the engineered TCR (including e.g., a TCR alpha chain domain, a TCR beta chain domain, a TCR CD3 chain domain, a TCR zeta chain domain, a TCR CD3-zeta chain domain a TCR extracellular domain, a TCR intracellular domain, a TCR variable region domain, a TCR constant region domain, a TCR IgSF domain, etc., or a function thereof) and/or negatively impact the dimerization function of the dimerizer domain.

An engineered TCR may include one or more epsilon, sigma, or gamma chains, or in some instances, an engineered TCR may not include one or more epsilon, sigma, or gamma chains and may instead rely upon endogenously expressed epsilon, sigma, or gamma chains. In some instances, an engineered TCR may not include one or more CD3-zeta chains and may instead rely on endogenously expressed CD3-zeta.

In some instances, the dimerizer domain may be inserted into an extracellular portion of the engineered TCR. In some instances the dimerizer domain (first or second member of the dimerization pair) may be inserted into an intracellular portion of the engineered TCR.

In some instances, the dimerizer domain may be inserted into or linked to an alpha chain of the engineered TCR. In some instances, the dimerizer domain is inserted or linked such that following the insertion or linking the dimerizer domain is linked intracellularly to the alpha chain including e.g., where the dimerizer domain is linked to the cytoplasmic side of the alpha chain transmembrane domain. In some instances, the dimerizer domain is inserted or linked such that following the insertion or linking the dimerizer domain is linked extracellularly to the alpha chain including e.g., where the dimerizer domain is linked to the extracellular side of the alpha chain transmembrane domain, where the dimerizer domain is inserted between the alpha chain transmembrane domain and the alpha chain constant region domain, etc.

In some instances, the dimerizer domain may be inserted into or linked to a beta chain of the engineered TCR. In some instances, the dimerizer domain is inserted or linked such that following the insertion or linking the dimerizer domain is linked intracellularly to the beta chain including e.g., where the dimerizer domain is linked to the cytoplasmic side of the beta chain transmembrane. In some instances, the dimerizer domain is inserted or linked such that following the insertion or linking the dimerizer domain is linked extracellularly to the beta chain including e.g., where the dimerizer domain is linked to the extracellular side of the beta chain transmembrane domain, where the dimerizer domain is inserted between the beta chain transmembrane domain and the beta chain constant region domain, etc.

In some instances, the dimerizer domain may be inserted into or linked to a fused alpha-CD3-zeta chain, e.g., where the CD3-zeta chain is full-length CD3-zeta (e.g., a TCR:zeta fusion) of the engineered TCR. In some instances, the dimerizer domain is inserted or linked such that following the insertion or linking the dimerizer domain is linked intracellularly to the fused alpha-CD3-zeta chain including e.g., where the dimerizer domain is inserted between the CD3-zeta transmembrane domain and other intracellular domains of the fused alpha-CD3-zeta chain, including e.g., one or more intracellular ITAM domains. In some instances, the dimerizer domain is inserted or linked such that following the insertion or linking the dimerizer domain is linked extracellularly to the fused alpha-CD3-zeta chain including e.g., where the dimerizer domain is linked to the extracellular side of the CD3-zeta transmembrane domain, where the dimerizer domain is inserted between the extracellular alpha chain domain and the transmembrane domain of the fused CD3-zeta, etc.

In some instances, the dimerizer domain may be inserted into or linked to a fused beta-CD3-zeta chain, e.g., where the CD3-zeta chain is full-length CD3-zeta (e.g., a TCR:zeta fusion) of the engineered TCR. In some instances, the dimerizer domain is inserted or linked such that following the insertion or linking the dimerizer domain is linked intracellularly to the fused beta-CD3-zeta chain including e.g., where the dimerizer domain is inserted between the CD3-zeta transmembrane domain and other intracellular domains of the fused beta-CD3-zeta chain, including e.g., one or more intracellular ITAM domains. In some instances, the dimerizer domain is inserted or linked such that following the insertion or linking the dimerizer domain is linked extracellularly to the fused beta-CD3-zeta chain including e.g., where the dimerizer domain is linked to the extracellular side of the CD3-zeta transmembrane domain, where the dimerizer domain is inserted between the extracellular beta chain domain and the transmembrane domain of the fused CD3-zeta, etc.

In some instances, the dimerizer domain may be inserted into or linked to a fused alpha-CD3-zeta domain (e.g., in an engineered TCR alpha-zeta+beta-zeta fusion) of the engineered TCR. In some instances, the dimerizer domain is inserted or linked such that following the insertion or linking the dimerizer domain is linked intracellularly to the fused alpha-CD3-zeta domain including e.g., where the dimerizer domain is inserted between one or more domains of the CD3-zeta domain and the transmembrane domain of the alpha chain. In some instances, the dimerizer domain is inserted or linked such that following the insertion or linking the dimerizer domain is linked extracellularly to the fused alpha-CD3-zeta domain including e.g., where the dimerizer domain is linked to the extracellular side of the alpha chain transmembrane domain, where the dimerizer domain is inserted between the alpha chain transmembrane domain and the alpha chain constant region domain, etc.

In some instances, the dimerizer domain may be inserted into or linked to a fused beta-CD3-zeta domain (e.g., in an engineered TCR alpha-zeta+beta-zeta fusion) of the engineered TCR. In some instances, the dimerizer domain is inserted or linked such that following the insertion or linking the dimerizer domain is linked intracellularly to the fused beta-CD3-zeta domain including e.g., where the dimerizer domain is inserted between one or more domains of the CD3-zeta domain and the transmembrane domain of the beta chain. In some instances, the dimerizer domain is inserted or linked such that following the insertion or linking the dimerizer domain is linked extracellularly to the fused beta-CD3-zeta domain including e.g., where the dimerizer domain is linked to the extracellular side of the beta chain transmembrane domain, where the dimerizer domain is inserted between the beta chain transmembrane domain and the beta chain constant region domain, etc.

In some instances, the dimerizer domain may be inserted into or linked to a chain of an engineered single chain TCR (e.g., in an engineered single chain TCR:zeta fusion, e.g., where a TCR alpha chain variable domain is linked to a TCR beta chain which is fused to a full-length CD3-zeta chain). In some instances, the dimerizer domain is inserted or linked such that following the insertion or linking the dimerizer domain is linked intracellularly to the engineered single chain TCR including e.g., where the dimerizer domain is inserted between one or more domains of the CD3-zeta chain and the transmembrane domain of the CD3-zeta chain. In some instances, the dimerizer domain is inserted or linked such that following the insertion or linking the dimerizer domain is linked extracellularly to the engineered single chain TCR including e.g., where the dimerizer domain is linked to the extracellular side of the CD3-zeta chain transmembrane domain, where the dimerizer domain is inserted between the CD3-zeta chain transmembrane domain and the beta chain constant region domain, etc.

In some instances, only a single dimerizer domain may be present in a conditionally repressible engineered TCR, e.g., where a single dimerizer domain is linked or inserted into an alpha chain of the engineered TCR, where a single dimerizer domain is linked or inserted into a beta chain of the engineered TCR, where a single dimerizer domain is linked or inserted into a CD3-zeta chain of the engineered TCR, etc.

In some instances, two or more dimerizer domains may be present in a conditionally repressible engineered TCR. For example, two dimerizer domains may be present in a conditionally repressible engineered TCR, e.g., where a first dimerizer domain is linked or inserted into an alpha chain of the engineered TCR and a second dimerizer domain is linked or inserted into a beta chain of the engineered TCR, where a first dimerizer domain is linked or inserted into a first CD3-zeta chain of the engineered TCR and a second dimerizer domain is linked or inserted into a second CD3-zeta chain of the engineered TCR, etc.

In some instances, the engineered TCR of a conditionally repressible TCR may be an engineered TCR variant including but not limited to, e.g., TCR variants that include one or more variant or mutant TCR chains. In some instances, the engineered TCR of a conditionally repressible TCR may include one or more non-modified chains, including but not limited to a non-modified alpha chain, a non-modified beta chain, etc. In some instances, the engineered TCR of a conditionally repressible TCR may include one or more murinized chains, including but not limited to, e.g., a murinized alpha chain, a murinized beta chain, etc. In some instances, the engineered TCR of a conditionally repressible TCR may include one or more cysteine modified chains, including but not limited to, e.g., a cysteine modified alpha chain, a cysteine modified beta chain, etc. In some instances, the engineered TCR of a conditionally repressible TCR may include a combination of variant TCR chains, including but not limited to a combination of murinized and cysteine-modified chains, including but not limited to, e.g., a murinized and cysteine-modified alpha chain, a murinized and cysteine-modified beta chain, a murinized alpha chain and cysteine-modified beta chain, a murinized beta chain and cysteine-modified alpha chain, etc.

In instances where a heteromeric, conditionally repressible synthetic ICR includes, in part or in whole, or the heteromeric, conditionally repressible synthetic ICR is essentially a modified TCR, the TCR may contain non-modified TRC chains having extracellular domains or the extracellular domains therefore present in modified TCR chains, one or more intracellular stimulatory domains present in non-modified or modified TCR chains and the transmembrane domains of such extracellular domain-containing or intracellular domain-containing chains. Such a TCR may optionally include linker regions and/or hinge regions. TCRs as part of a heteromeric, conditionally repressible synthetic ICR may be encompassed within a single polypeptide (e.g., as in engineered single chain TCRs) or various chains and portions thereof may be "split" across two or more polypeptides.

TCR Chains

Many native TCRs exist in heterodimeric αβ or γδ forms. However, recombinant or engineered TCR may include a single TCR α or TCR β chain and may bind to peptide MHC molecules. In certain embodiments, an engineered TCR of a repressible ICR includes both an α chain variable domain and an TCR β chain variable domain. The chains of an engineered TCR useful in a repressible ICR of the instant disclosure may vary and may include any suitable native or synthetic or recombinant or mutant TCR chain or chains or combination thereof.

As will be apparent to those skilled in the art the mutation(s) in TCR chain sequence, including e.g., α chain sequence and/or TCR β chain sequence, may be one or more of substitution(s), deletion(s) or insertion(s). These mutations can be carried out using any appropriate method including, but not limited to, those based on polymerase chain reaction (PCR), restriction enzyme-based cloning, or ligation independent cloning (LIC) procedures. These methods are detailed in many standard molecular biology texts, including but not limited to e.g., Sambrook & Russell, (2001) Molecular Cloning—A Laboratory Manual (3$^{rd}$ Ed.) CSHL Press and Rashtchian, (1995) *Curr Opin Biotechnol* 6 (1): 30-6.

As used herein the term "variable domain" is understood to encompass all amino acids of a given TCR which are not included within the constant domain as encoded by the TRAC gene for TCR α chains and either the TRBC1 or TRBC2 for TCR β chains as described in, e.g., *T cell receptor Factsbook*, (2001) LeFranc and LeFranc, Academic Press.

In some instances, an engineered TCR has at least one TCR α chain domain having or derived from an amino acid sequence that is at least 70% identical, including at least 75% identical to, including at least 80% identical to, including at least 85% identical to, including at least 90% identical to, including at least 95% identical to or is 100% identical to the IG4 α chain amino acid sequence:

(SEQ ID NO: 675)
METLLGLLILWLQLQWVSSKQEVTQIPAALSVPEGENLVLNCSFTDSAIY

NLQWFRQDPGKGLTSLLLIQSSQREQTSGRLNASLDKSSGRSTLYIAASQ

PGDSATYLCAVRPTSGGSYIPTFGRGTSLIVHPPNIQNPDPAVYQLRDSK

SSDKSVCLFTDFDSQTNVSQSKDSDVYITDKTVLDMRSMDFKSNSAVAWS

-continued

NKSDFACANAFNNSIIPEDTFFPSPESSCDVKLVEKSFETDTNLNFQNLS

VIGFRILLLKVAGFNLLMTLRLWSS.

In some instances, an engineered TCR has at least one TCR α chain domain having or derived from an amino acid sequence that is at least 70% identical, including at least 75% identical to, including at least 80% identical to, including at least 85% identical to, including at least 90% identical to, including at least 95% identical to or is 100% identical to the IG4 α chain A95:LY mutant amino acid sequence:

(SEQ ID NO: 676)
METLLGLLILWLQLQWVSSKQEVTQIPAALSVPEGENLVLNCSFTDSAIY

NLQWFRQDPGKGLTSLLLIQSSQREQTSGRLNASLDKSSGRSTLYIAASQ

PGDSATYLCAVRPLYGGSYIPTFGRGTSLIVHPPNIQNPDPAVYQLRDSK

SSDKSVCLFTDFDSQTNVSQSKDSDVYITDKTVLDMRSMDFKSNSAVAWS

NKSDFACANAFNNSIIPEDTFFPSPESSCDVKLVEKSFETDTNLNFQNLS

VIGFRILLLKVAGFNLLMTLRLWSS.

In some instances, an engineered TCR has at least one TCR β chain domain having or derived from an amino acid sequence that is at least 70% identical, including at least 75% identical to, including at least 80% identical to, including at least 85% identical to, including at least 90% identical to, including at least 95% identical to or is 100% identical to the IG4 β chain amino acid sequence:

(SEQ ID NO: 677)
MSIGLLCCAALSLLWAGPVNAGVTQTPKFQVLKTGQSMTLQCAQDMNHEY

MSWYRQDPGMGLRLIHYSVGAGITDQGEVPNGYNVSRSTTEDFPLRLLSA

APSQTSVYFCASSYVGNTGELFFGEGSRLTVLEDLNKVFPPEVAVFEPSE

AEISHTQKATLVCLATGFFPDHVELSWWVNGKEVHSGVSTDPQPLKEQPA

LNDSRYCLSSRLRVSATFWQNPRNHFRCQVQFYGLSENDEWTQDRAKPVT

QIVSAEAWGRADCGFTSVSYQQGVLSATILYEILLGKATLYAVLVSALVL

MAMVKRKDF.

In some instances, an engineered TCR has at least one TCR β chain domain having or derived from an amino acid sequence that is at least 70% identical, including at least 75% identical to, including at least 80% identical to, including at least 85% identical to, including at least 90% identical to, including at least 95% identical to or is 100% identical to the IG4 β chain G51A mutant amino acid sequence:

(SEQ ID NO: 678)
MSIGLLCCAALSLLWAGPVNAGVTQTPKFQVLKTGQSMTLQCAQDMNHEY

MSWYRQDPGMGLRLIHYSVAAGITDQGEVPNGYNVSRSTTEDFPLRLLSA

APSQTSVYFCASSYVGNTGELFFGEGSRLTVLEDLNKVFPPEVAVFEPSE

AEISHTQKATLVCLATGFFPDHVELSWWVNGKEVHSGVSTDPQPLKEQPA

LNDSRYCLSSRLRVSATFWQNPRNHFRCQVQFYGLSENDEWTQDRAKPVT

QIVSAEAWGRADCGFTSVSYQQGVLSATILYEILLGKATLYAVLVSALVL

MAMVKRKDF.

In some instances, a NY-ESO-1-binding TCR has at least one TCR α chain variable domain having an amino acid sequence that is at least 70% identical, including at least 75% identical to, including at least 80% identical to, including at least 85% identical to, including at least 90% identical to, including at least 95% identical to or is 100% identical to the α chain extracellular sequence: oMQEVTQI-PAALSVPEGENLVLNCSFTD-SAIYNLQWFRQDPGKGLTSLLLIQSSQREQTSGRL-NAS LDKSSGRSTLYIAASQPGDSATYL-CAVRPTSGGSYIPTFGRGTSLIVHPYIQNPD-PAVYQLRDSKS SDKSVCLFTDFDSQTNVSQSKDSDVYITDKTVLDMR-SMDFKSNSAVAWSNKSDFACANAFNNS IIPEDTFFPSPESS (SEQ ID NO:679). In some instances, the α chain extracellular sequence contains one or more of the following amino acid substitutions: T95L and S96Y.

In some instances, a NY-ESO-1-binding TCR has at least one TCR β chain variable domain having an amino acid sequence that is at least 70% identical, including at least 75% identical to, including at least 80% identical to, including at least 85% identical to, including at least 90% identical to, including at least 95% identical to or is 100% identical to the β chain extracellular sequence:

(SEQ ID NO: 680)
MGVTQTPKFQVLKTGQSMTLQCAQDMNHEYMSWYRQDPGMGLRLIHYSVG

AGITDQGEVPNGYNVSRSTTEDFPLRLLSAAPSQTSVYFCASSYVGNTGE

LFFGEGSRLTVLEDLKNVFPPEVAVFEPSEAEISHTQKATLVCLATGFYP

DHVELSWWVNGKEVHSGVSTDPQPLKEQPALNDSRYALSSRLRVSATFWQ

DPRNHFRCQVQFYGLSENDEWTQDRAKPVTQIVSAEAWGRAD.

In some instances, the engineered TCR include an introduced disulfide bond between cysteines. For example, disulfide bond between cysteines may be introduced between substitute amino acids of two chains of the engineered including but not limited to, e.g., between an α chain and a β chain of the TCR. In some instances an engineered TCR may be a NY-ESO-1-binding TCR that includes a disulfide bond between cysteines of substitute amino acids of two chains of the engineered NY-ESO-1-binding TCR including but not limited to, e.g., between an α chain and a β chain of the engineered NY-ESO-1-binding TCR. For example, in some instances, an engineered NY-ESO-1-binding TCR may include a disulfide bond between cysteines substituted for alpha chain T162 and beta chain S169 of SEQ ID NOs:679-680.

Linkers

In some cases, a subject conditionally repressible TCR includes a linker between any two adjacent domains or artificially linked chains. For example, a linker can be disposed between the intracellular portion of a transmembrane domain of an alpha chain and a dimerizer domain of the conditionally repressible TCR. In some instances, a linker can be disposed between the intracellular portion of a transmembrane domain of a beta chain and a dimerizer domain of the conditionally repressible TCR. In some instances, a linker can be disposed between the transmembrane domain of an alpha chain and the first intracellular functional domain of a linked CD3-zeta chain of the conditionally repressible TCR. In some instances, a linker can be disposed between the transmembrane domain of a beta chain and the first intracellular functional domain of a linked CD3-zeta chain of the conditionally repressible TCR. As another example, a linker can be disposed between any domain of the conditionally repressible TCR and any additional domain including e.g., a domain not involved in the primary immune activation functions of the conditionally repressible TCR including but not limited to e.g., a reporter domain, a tag domain, etc.

Linkers may be utilized in a suitable configuration in the conditionally repressible TCR provided they do not abolish the primary activities of the conditionally repressible TCR including, e.g., the ability of the conditionally repressible TCR to activate an immune cell, the ability of the dimerization domain of the conditionally repressible TCR to bind the dimerization domain of the synthetic ICR repressor, etc.

Any suitable linker, including two or more linkers (e.g., where the two or more linkers are the same or different and including where the multiple linkers are three or more, four or more, five or more, six or more, etc. and including where all the linkers are different and where the multiple linkers include an mix of some linkers utilized in more than one location and some linkers utilized specifically in only one location and the like) may be utilized in the subject conditionally repressible TCRs including e.g., those linkers described herein for acceptable use in a CAR.

Synthetic ICR Repressor

As described herein, a heteromeric, conditionally repressible synthetic ICR includes a synthetic ICR repressor, also referred to herein as an "ICR repressor" or "inhibitory part" for simplicity. Such inhibitory ICRs will vary depending on the particular context of immune cell repression to which the construct is directed and will generally function to mediate repression of an activated or activatable immune cell expressing a stimulatory ICR and the ICR repressor. Thus, an ICR repressor includes an inhibitory domain that functions to repress immune cell activation attributed to the stimulatory ICR upon dimerization of reciprocal dimerizer domains present in the ICR repressor and the stimulatory ICR when dimerizer is present.

A ICR repressor therefore includes one or more intracellular inhibitory domains that mediates intracellular signaling leading to inhibition of immune cell activation in immune cells expressing the stimulatory ICR. Domains useful as inhibitory domains will vary depending on the particular context of immune cell activation and repression, including e.g., the particular type of activated cell to be repressed and the desired degree of repression. Exemplary non-limited examples of inhibitory domains, described in greater detail below, include but are not limited to domains and motifs thereof derived from immune receptors including, e.g., co-inhibitory molecules, immune checkpoint molecules, immune tolerance molecules, and the like.

An ICR repressor further includes, as described in more detail below, a domain of a dimerization pair. Useful dimerization domains will vary depending on the desired dimerizer and the desired relative position of the dimerization domain within the ICR repressor. Generally, the presence of a first domain of a dimerization pair within the stimulatory ICR mediates the dimerization, upon introduction of the dimerizer, with a second domain of the dimerization pair present in the ICR repressor such that upon dimerization the ICR repressor represses immune cell activation due to the stimulatory ICR.

An ICR repressor may, optionally, include a transmembrane domain. As such, ICR repressors as described herein may or may not be membrane tethered. As such, an ICR repressor may contain a transmembrane domain, or portion thereof, and thus may be a membrane-bound ICR repressor. In other instances, an ICR repressor may lack a transmembrane domain and thus may be a cytosolic ICR repressor. Such transmembrane domains useful in an ICR repressor of the instant disclosure are described further herein.

In some instances, an ICR repressor may further include additional domains. Such additional domains may be functional, e.g., they directly contribute to the immune cell activation inhibition function of the ICR repressor, or non-functional, e.g., they do not directly contribute to the repression function of the ICR repressor. Non-functional additional domains may include domains having various purposes that do not directly affect the ability of the ICR repressor to repress immune cell activation including, but not limited to, e.g., structural functions, linker functions, etc.

Intracellular Inhibitory Domain

A stimulatory domain suitable for use in a synthetic ICR repressor of a subject repressible ICR may be any functional unit of a polypeptide as short as a 3 amino acid linear motif and as long as an entire protein, where size of the stimulatory domain is restricted only in that the domain must be sufficiently large as to retain its function and sufficiently small so as to be compatible with the other components of the repressible ICR. Accordingly, an inhibitory domain may range in size from 3 amino acids in length to 1000 amino acids or more and, in some instances, can have a length of from about 30 amino acids to about 70 amino acids (aa), e.g., an inhibitory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, stimulatory domain can have a length of from about 70 aa to about 100 aa, from about 100 aa to about 200 aa, or greater than 200 aa.

In some instances, "co-inhibitory domains" find use in the synthetic ICR repressor of the present disclosure. Such co-inhibitory domains are generally polypeptides derived from receptors. Co-inhibition generally refers to the secondary inhibition of primary antigen-specific activation mechanisms which prevents co-stimulation. Co-inhibition, e.g., T cell co-inhibition, and the factors involved have been described in Chen & Flies. *Nat Rev Immunol* (2013) 13(4): 227-42 and Thaventhiran et al. *J Clin Cell Immunol* (2012) S12, the disclosures of which are incorporated herein by reference in their entirety. In some embodiments, co-inhibitory domains homodimerize. A subject co-inhibitory domain can be an intracellular portion of a transmembrane protein (i.e., the co-inhibitory domain can be derived from a transmembrane protein). Non-limiting examples of suitable co-inhibitory polypeptides include, but are not limited to, CTLA-4 and PD-1. In some instances, a co-inhibitory domain, e.g., as used in a synthetic ICR repressor of the instant disclosure may include a co-inhibitory domain listed in FIG. 27, which provides Table 1. In some instances, a co-inhibitory domain of a synthetic ICR repressor comprises an amino acid sequence having at least about 75%, at least about 80%, at least about 85%, at least about 90%, at least about 95%, at least about 98%, or 100% amino acid sequence identity to a co-inhibitory domain as described herein.

In some instances, a synthetic ICR repressor may contain an intracellular signaling domain, e.g., a co-inhibitory domain, derived from an intracellular portion of the transmembrane protein PD-1 (also known as CD279, programmed cell death 1; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: ICSRAARGTIGARRTGQPLKEDP-SAVPVFSVDYGELDFQWREKTPEPPVPCVPEQTEYA-TIVFPS GMGTSSPARRGSADGPR-SAQPLRPEDGHCSWPL (SEQ ID NO:681). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, or from about 95 aa to about 100 aa.

In some instances, a synthetic ICR repressor may contain an intracellular signaling domain, e.g., a co-inhibitory domain, derived from an intracellular portion of the transmembrane protein CTLA4 (also known as CD152, Cytotoxic T-lymphocyte protein 4, Cytotoxic T-lymphocyte-associated antigen 4; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: SLSKMLKKR-SPLTTGVYVKMPPTEPECEKQFQPYFIPIN (SEQ ID NO:682). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa.

In some instances, a synthetic ICR repressor may contain an intracellular signaling domain, e.g., a co-inhibitory domain, derived from an intracellular portion of the transmembrane protein HPK1 (also known as MAP4K1, Mitogen-activated protein kinase kinase kinase kinase 1, Hematopoietic progenitor kinase, MAPK/ERK kinase kinase kinase 1, MEK kinase kinase 1, MEKKK 1; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: YDLLQRLGGGTYGEVFKARDKVSGDLVALKMVK-MEPDDDVSTLQKEILILKTCRHANIVAYH GSYLWLQKLWICMEFCGAGSLQDIYQVTGSLSELQI-SYVCREVLQGLAYLHSQKKIHRDIKGAN ILINDA-GEVRLADFGISAQIGATLARRLSFIGTPYWMAPE-VAAVALKGGYNELCDIWSLGITAIEL AELQPPLFDVHPLRVLFLMTKSGYQP-PRLKEKGKWSAAFHNFIKVTLTKSPKKRP-SATKMLSHQ LV (SEQ ID NO:683). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165 aa, from about 165 aa to about 170 aa, from about 170 aa to about 175 aa, from about 175 aa to about 180 aa, from about 180 aa to about 185 aa, from about 185 aa to about 190 aa, from about 190 aa to about 195 aa, from about 195 aa to about 200 aa, from about 200 aa to about 205 aa, from about 205 aa to about 210 aa, from about 210 aa to about 215 aa, from about 215 aa to about 220 aa, from about 220 aa to about 225 aa, from about 225 aa to about 230 aa, from about 230 aa to about 235 aa, from about 235 aa to about 240 aa, from about 240 aa to about 245 aa, from about 245 aa to about 250 aa, from about 250 aa to about 255 aa or from about 255 aa to about 258 aa.

In some instances, a synthetic ICR repressor may contain an intracellular signaling domain, e.g., a co-inhibitory domain, derived from an intracellular portion of the transmembrane protein SHP1 (also known as PTN6, Tyrosine-protein phosphatase non-receptor type 6, Hematopoietic cell protein-tyrosine phosphatase, Protein-tyrosine phosphatase 1C, PTP-1C, SH-PTP1, HCP, PTP1C; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: FWEEF-ESLQKQEVKNLHQRLEGQRPENKGKNRYKNIL-PFDHSRVILQGRDSNIPGSDYINANYIK NQLLGPDE-NAKTYIASQGCLEATVNDFWQMAWQENSRVIVMTT-REVEKGRNKCVPYWPEVG MQRAYGPYSVTNCGEHDTTEYKLRTLQVSPLDNGD-LIREIWHYQYLSWPDHGVPSEPGGVLSF LDQINQRQESLPHAGPIIVHCSAGIGRTGTIIVIDML-MENISTKGLDCDIDIQKTIQMVRAQRSGM VQTEA-QYKFIYVAIAQF (SEQ ID NO:684). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165 aa, from about 165 aa to about 170 aa, from about 170 aa to about 175 aa, from about 175 aa to about 180 aa, from about 180 aa to about 185 aa, from about 185 aa to about 190 aa, from about 190 aa to about 195 aa, from about 195 aa to about 200 aa, from about 200 aa to about 205 aa, from about 205 aa to about 210 aa, from about 210 aa to about 215 aa, from about 215 aa to about 220 aa, from about 220 aa to about 225 aa, from about 225 aa to about 230 aa, from about 230 aa to about 235 aa, from about 235 aa to about 240 aa, from about 240 aa to about 245 aa, from about 245 aa to about 250 aa, from about 250 aa to about 255 aa, from about 255 aa to about 260 aa, from about 260 aa to about 265 aa, from about 265 aa to about 270 aa or from about 270 aa to about 272 aa.

In some instances, a synthetic ICR repressor may contain an intracellular signaling domain, e.g., a co-inhibitory domain, derived from an intracellular portion of the transmembrane protein SHP2 (also known as PTN11, Tyrosine-protein phosphatase non-receptor type 11, Protein-tyrosine phosphatase 1D, PTP-1D, Protein-tyrosine phosphatase 2C, PTP-2C, SH-PTP2, SHP-2, SH-PTP3, PTP2C, SHPTP2; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: FWEEFETLQQQECKLLYSRKEGQRQENKNKNRYK-NILPFDHTRVVLHDGDPNEPVSDYINANII MPE-FETKCNNSKPKKSYIATQGCLQNTVND-FWRMVFQENSRVIVMTTKEVERGKSKCVKYWP DEYALKEYGVMRVRNVKESAAHDYTLRELKL-SKVGQALLQGNTERTVWQYHFRTWPDHGVP SDPGGVLDFLEEVHHKQESIMDAGPVVVHCSAG-IGRTGTFIVIDILIDIIREKGVDCDIDVPKTIQM VRSQRSGMVQTEAQYRFIYMA (SEQ ID NO:685). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165 aa, from about 165 aa to about 170 aa, from about 170 aa to about 175 aa, from about 175 aa to about 180 aa, from about 180 aa to about 185 aa, from about 185 aa to about 190 aa, from about 190 aa to about 195 aa, from about 195 aa to about 200 aa, from about 200 aa to about 205 aa, from about 205 aa to about 210 aa, from about 210 aa to about 215 aa, from about 215 aa to about 220 aa, from about 220 aa to about 225 aa, from about 225 aa to about 230 aa, from about 230 aa to about 235 aa, from about 235 aa to about 240 aa, from about 240 aa to about 245 aa, from about 245 aa to about 250 aa, from about 250 aa to about 255 aa, from about 255 aa to about 260 aa, from about 260 aa to about 265 aa or from about 265 aa to about 270 aa or from about 270 aa to about 275 aa.

In some instances, a synthetic ICR repressor may contain an intracellular signaling domain, e.g., a co-inhibitory domain, derived from an intracellular portion of the transmembrane protein Sts1 (also known as UBS3B, Ubiquitin-associated and SH3 domain-containing protein B, Cb1-interacting protein p70, Suppressor of T-cell receptor signaling 1, STS-1, T-cell ubiquitin ligand 2, TULA-2, Tyrosine-protein phosphatase STS1/TULA2, UBASH3B, KIAA1959; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: GPQKRCLFVCRHGER-MDVVFGKYWLSQCFDAKGRYIRTNLNMPHSLPQRS-GGFRDYEKDAPIT VFGCMQARLVGEALLESNTI-IDHVYCSPSLRCVQTAHNILKGLQQENHLKIRVE-PGLFEWTKWV AGSTLPAWIPPSELAAANLSVDT-TYRPHIPISKLVVSESYDTYISRSFQVTKEIISECKSKG-NNILIV AHASSLEACTCQLQGL-SPQNSKDFVQMVRKIPYLGFCSCEEL-GETGIWQLTDPPILPLTHGPTGG FNWRETLLQE (SEQ ID NO:686). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165 aa, from about 165 aa to about 170 aa, from about 170 aa to about 175 aa, from about 175 aa to about 180 aa, from about 180 aa to about 185 aa, from about 185 aa to about 190 aa, from about 190 aa to about 195 aa, from about 195 aa to about 200 aa, from about 200 aa to about 205 aa, from about 205 aa to about 210 aa, from about 210 aa to about 215 aa, from about 215 aa to about 220 aa, from about 220 aa to about 225 aa, from about 225 aa to about 230 aa, from about 230 aa to about 235 aa, from about 235 aa to about 240 aa, from about 240 aa to about 245 aa, from about 245 aa to about 250 aa, from about 250 aa to about 255 aa, from about 255 aa to about 260 aa, from about 260 aa to about 265 aa or from about 265 aa to about 270 aa.

In some instances, a synthetic ICR repressor may contain an intracellular signaling domain, e.g., a co-inhibitory domain, derived from an intracellular portion of the transmembrane protein Csk (also known as Tyrosine-protein kinase CSK, C-Src kinase, Protein-tyrosine kinase CYL; etc.). For example, a suitable co-inhibitory domain can comprise an amino acid sequence having at least about 75%, at least about 80%, at least about 85%, at least about 90%, at least about 95%, at least about 98%, or 100% amino acid sequence identity to the following amino acid sequence: LKLLQTIGKGEFGDVMLGDYRGNKVAVKCIKN-DATAQAFLAEASVMTQLRHSNLVQLLGVIVE EKG-GLYIVTEYMAKGSLVDYLRSRGRSVLGGD-CLLKFSLDVCEAMEYLEGNNFVHRDLAARN VLVSEDNVAKVSDFGLTKEAS-STQDTGKLPVKWTAPEALREKKFSTKSDVWSFGILL-WEIYSFG RVPYPRIPLKDVVPRVEKGYKMDAP-DGCPPAVYEVMKNCWHLDAAMRPSFLQLREQLEHI-KT HELH (SEQ ID NO:687). In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165 aa, from about 165 aa to about 170 aa, from about 170 aa to about 175 aa, from about 175 aa to about 180 aa, from about 180 aa to about 185 aa, from about 185 aa to about 190 aa, from about 190 aa to about 195 aa, from about 195 aa to about 200 aa, from about 200 aa to about 205 aa, from about 205 aa to about 210 aa, from about 210 aa to about 215 aa, from about 215 aa to about 220 aa, from about 220 aa to about 225 aa, from about 225 aa to about 230 aa, from about 230 aa to about 235 aa, from about 235 aa to about 240 aa, from about 240 aa to about 245 aa, from about 245 aa to about 250 aa or from about 250 aa to about 255 aa.

In some instances, a synthetic ICR repressor may contain an intracellular signaling domain, e.g., a co-inhibitory domain, derived from an intracellular portion of a transmembrane protein listed in Table 1. For example, a suitable co-inhibitory domain can comprise an amino acid sequence having at least about 75%, at least about 80%, at least about 85%, at least about 90%, at least about 95%, at least about 98%, or 100% amino acid sequence identity to an amino acid sequence listed in Table 1. In some of these embodiments, the co-inhibitory domain has a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa, from about 70 aa to about 75 aa, from about 75 aa to about 80 aa, from about 80 aa to about 85 aa, from about 85 aa to about 90 aa, from about 90 aa to about 95 aa, from about 95 aa to about 100 aa, from about 100 aa to about 105 aa, from about 105 aa to about 110 aa, from about 110 aa to about 115 aa, from about 115 aa to about 120 aa, from about 120 aa to about 125 aa, from about 125 aa to about 130 aa, from about 130 aa to about 135 aa, from about 135 aa to about 140 aa, from about 140 aa to about 145 aa, from about 145 aa to about 150 aa, from about 150 aa to about 155 aa, from about 155 aa to about 160 aa, from about 160 aa to about 165, aa from about 165 aa to about 170 aa, from about 170 aa to about 175 aa, from about 175 aa to about 180 aa, from about 180 aa to about 185 aa, or from about 185 aa to about 190 aa.

Transmembrane Domain

Any transmembrane (TM) domain that provides for insertion of a polypeptide into the cell membrane of a eukaryotic (e.g., mammalian) cell is suitable for use. As one non-limiting example, the TM sequence IYIWAPLAGTCGVLLLSLVITLYC (SEQ ID NO:688) can be used. Additional non-limiting examples of suitable TM sequences include: a) CD8 beta derived: LGLLVAGVLVLLVSLGVAIHLCC (SEQ ID NO:689); b) CD4 derived: ALIVLGGVAGLLLFIGLGIFFCVRC (SEQ ID NO:690); c) CD3 zeta derived: LCYLLDGILFIYGVILTALFLRV (SEQ ID NO:691); d) CD28 derived: WVLVVVGGVLACYSLLVTVAFIIFWV (SEQ ID NO:692); e) CD134 (OX40) derived: VAAILGLGLVLGLLGPLAILLALYLL (SEQ ID NO:693); and f) CD7 derived: ALPAALAVISFLLGLGLGVACVLA (SEQ ID NO:694).

Linkers

In some cases, a subject synthetic ICR repressor includes a linker between any two adjacent domains. For example, a linker can be disposed between the transmembrane domain, where present, and the first intracellular functional domain, e.g., a co-inhibitory domain, of the synthetic ICR repressor. As another example, a linker can be disposed between a first intracellular functional domain and the member of the dimerization domain of the synthetic ICR repressor. As another example, a linker can be disposed the transmembrane domain, where present, and the member of the dimerization domain of the synthetic ICR repressor. As another example, a linker can be disposed between the member of the dimerization domain and a second intracellular functional domain, e.g., an immune cell negative regulatory domain. As another example, a linker can be disposed between any domain of the synthetic ICR repressor and any additional domain including e.g., a domain not involved in the primary immune repression functions of the synthetic ICR repressor including but not limited to e.g., a reporter domain, a tag domain, etc.

Linkers may be utilized in a suitable configuration in the synthetic ICR repressor provided they do not abolish the primary activities of the synthetic ICR repressor including, e.g., the ability of the synthetic ICR repressor to repress an activated ICR, the ability of the dimerization domain of the synthetic ICR repressor to bind the dimerization domain of the repressible ICR.

Any suitable linker, including two or more linkers (e.g., where the two or more linkers are the same or different and including where the multiple linkers are three or more, four or more, five or more, six or more, etc. and including where all the linkers are different and where the multiple linkers include an mix of some linkers utilized in more than one location and some linkers utilized specifically in only one location and the like) may be utilized in the subject synthetic ICR repressors including e.g., those linkers described herein for acceptable use in a CAR.

Additional Sequences

The heteromeric, conditionally repressible synthetic ICR of the instant disclosure may further include one or more additional polypeptide domains, where such domains include, but are not limited to, a signal sequence; an epitope tag; an affinity domain; and a polypeptide that produces a detectable signal.

Signal Sequences

Signal sequences that are suitable for use in a subject repressible synthetic ICR, e.g., in the stimulatory ICR or the ICR repressor, include any eukaryotic signal sequence, including a naturally-occurring signal sequence, a synthetic (e.g., man-made) signal sequence, etc.

Epitope Tag

Suitable epitope tags include, but are not limited to, hemagglutinin (HA; e.g., YPYDVPDYA (SEQ ID NO:594); FLAG (e.g., DYKDDDDK (SEQ ID NO:595); c-myc (e.g., EQKLISEEDL; SEQ ID NO:596), and the like.

Affinity Domain

Affinity domains include peptide sequences that can interact with a binding partner, e.g., such as one immobilized on a solid support, useful for identification or purification. DNA sequences encoding multiple consecutive single amino acids, such as histidine, when fused to the expressed protein, may be used for one-step purification of the recombinant protein by high affinity binding to a resin column, such as nickel sepharose. Exemplary affinity domains include His5 (HHHHH) (SEQ ID NO:597), HisX6 (HHHHHH) (SEQ ID NO:598), C-myc (EQKLISEEDL) (SEQ ID NO:599), Flag (DYKDDDDK) (SEQ ID NO:600), StrepTag (WSHPQFEK) (SEQ ID NO:601), hemagglutinin, e.g., HA Tag (YPYDVPDYA) (SEQ ID NO:602), GST, thioredoxin, cellulose binding domain, RYIRS (SEQ ID NO:603), Phe-His-His-Thr (SEQ ID NO:604), chitin binding domain, S-peptide, T7 peptide, SH2 domain, C-end RNA tag, WEAAAREACCRECCARA (SEQ ID NO:605), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, S100 proteins, parvalbumin, calbindin D9K, calbindin D28K, and calretinin, inteins, biotin, streptavidin, MyoD, Id, leucine zipper sequences, and maltose binding protein.

Detectable Signal-Producing Polypeptides

Suitable detectable signal-producing proteins include, e.g., fluorescent proteins; enzymes that catalyze a reaction that generates a detectable signal as a product; and the like.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilised EGFP (dEGFP), destabilised ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, *Renilla* GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, mPlum (Shaner et al. (2005) *Nat. Methods* 2:905-909), and the like. Any of a variety of fluorescent and colored proteins from Anthozoan species, as described in, e.g., Matz et al. (1999) *Nature Biotechnol.* 17:969-973, is suitable for use.

Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, glucose oxidase (GO), and the like.

Conditionally Active Dimerization-Dependent Cell-Surface Receptors

In some cases, a conditionally active heterodimeric polypeptide of the present disclosure is a conditionally active dimerization-dependent cell-surface receptor. By "conditionally active dimerization-dependent cell-surface receptor" is meant a variant of a cell surface receptor that is naturally dependent on dimerization for signal propagation, e.g., through ligand-binding induced dimerization, where the variant comprises a modification (e.g., a modification of a naturally-occurring cell surface receptor or other parental cell surface receptor) such that it includes one member of a dimerization pair and is conditionally dependent on dimerization of the dimerization pair induced by the presence of a dimerizing agent. As such, a conditionally acitive dimerization-dependent cell-surface receptor of the present disclosure will generally include a cell-surface receptor polypeptide which comprises a first member of a dimerization pair paired with a cell-surface receptor polypeptide which comprises a second member of the dimerization pair. For example, in some embodiments, a first dimerization-dependent cell-surface receptor that naturally forms a dimer in the presence of a ligand is modified to include a LBD of a nuclear hormone receptor and a second dimerization-dependent cell-surface receptor is modified to include a co-regulator of the nuclear hormone receptor such that the first dimerization-dependent cell-surface receptor and the second dimerization-dependent cell-surface receptor are dimerized in the presence of a dimerization agent that induces binding of the LBD to the co-regulator.

In some cases, the first and second dimerization-dependent cell-surface receptor may be the same dimerization-dependent cell-surface receptor, i.e., the first and second dimerization-dependent cell-surface receptors naturally form a homodimer in the presence of a dimerizing ligand. Accordingly, in some instances, the first and second conditionally acitive dimerization-dependent cell-surface receptors may only differ in that one includes a LBD of a nuclear hormone receptor and the other includes a co-regulator of the nuclear hormone receptor.

In some cases, the first and second dimerization-dependent cell-surface receptor may be different dimerization-dependent cell-surface receptors, i.e., the first and second dimerization-dependent cell-surface receptors naturally form a heterodimer in the presence of a dimerizing ligand. Accordingly, in some instances, the first and second conditionally acitive dimerization-dependent cell-surface receptors may differ in one or more domains besides the LBD of a nuclear hormone receptor present in one member and the co-regulator of the nuclear hormone receptor present in the other member.

By "dimerization-dependent cell-surface receptor" is meant any cell-surface receptor polypeptide which depends upon dimerization with a second polypeptide to propagate an intracellular signal. In its natural context, a dimerization-dependent cell-surface receptor will generally dimerize in response to binding a ligand of the receptor. Useful dimerization-dependent cell-surface receptors include those that dimerize to form homodimers, those that dimerize to form heterodimers, as well as those that dimerize to form homodimers or heterodimers depending on the context.

Conditionally active dimerization-dependent cell-surface receptors of the present disclosure may be constructed in various ways. In some cases, a LBD of a nuclear hormone receptor or a co-regulator of a nuclear hormone receptor is appended to or recombinantly inserted into the otherwise unmodified dimerization-dependent cell-surface receptor. In some cases, one or more domains of the dimerization-dependent cell-surface receptor are replaced with a nuclear hormone receptor or a co-regulator of a nuclear hormone receptor. In some cases, a LBD of a nuclear hormone receptor or a co-regulator of a nuclear hormone receptor may be appended to or recombinantly inserted into a modified dimerization-dependent cell-surface receptor, e.g., a dimerization-dependent cell-surface receptor that has been modified to remove its natural ligand binding activity or other render it unable to bind its natural receptor ligand (e.g., by deletion of all or a portion of the endogenous ligand binding domain, buy mutation of the ligand binding domain, etc.). In some cases, the endogenous ligand binding domain of a dimerization-dependent cell-surface receptor may be replaced with a LBD of a nuclear hormone receptor or a co-regulator of a nuclear hormone receptor.

For example, in some embodiments, the endogengous ligand binding domain of a cytokine receptor may be replaced with a LBD of a nuclear hormone receptor or a co-regulator of a nuclear hormone receptor of the subject disclosure to generate a conditionally active dimerization-dependent cytokine receptor. In some embodiments, the endogengous ligand binding domain of a cytokine receptor may be completely or partially removed and a LBD of a nuclear hormone receptor or a co-regulator of a nuclear hormone receptor of the subject disclosure may be appended to or inserted into the modified cytokine receptor to generate a conditionally active dimerization-dependent cytokine receptor.

In some embodiments, the endogengous ligand binding domain of a RTK may be replaced with a LBD of a nuclear hormone receptor or a co-regulator of a nuclear hormone receptor of the subject disclosure to generate a conditionally active dimerization-dependent RTK. In some embodiments, the endogengous ligand binding domain of a RTK may be completely or partially removed and a LBD of a nuclear hormone receptor or a co-regulator of a nuclear hormone receptor of the subject disclosure may be appended to or inserted into the modified RTK to generate a conditionally active dimerization-dependent RTK.

Cytokine Receptors

As noted above, useful non-limiting examples of dimerization-dependent cell-surface receptors include cytokine receptors, including e.g., cytokine receptors that form homodimers and cytokine receptors that form heterodimers. Useful cytokine receptors include but are not limited to e.g., IL-2 family receptors, IL-3 family receptors, IL-6 family receptors, IL-12 family receptors, prolactin family receptors, interferon family receptors, IL-10 family receptors, IL-17 family receptors, immunoglobulin-like superfamily receptors, tumor necrosis factor family receptors, chemokine receptors, TGF-beta family receptors, and the like.

Non-limiting examples of IL-2 family receptors include Interleukin 13 receptor, a2; Interleukin-2 receptor subunit α; Interleukin-2 receptor subunit β; Interleukin-2 receptor subunit γ; Interleukin-4 receptor subunit α; Interleukin-7 receptor subunit α; Interleukin 9 receptor; Interleukin-13 receptor subunit α1; Interleukin-15 receptor subunit α; Interleukin 21 receptor; Cytokine receptor-like factor 2, and the like. The amino acid sequences of such examples are provided in FIG. 53.

Non-limiting examples of IL-3 family receptors include Interleukin 3 receptor, α subunit; Interleukin 5 receptor, α subunit; GM-CSF receptor, α subunit; Cytokine receptor common β subunit; and the like. The amino acid sequences of such examples are provided in FIG. 54.

Non-limiting examples of IL-6 family receptors include Leptin receptor; IL6R (Interleukin-6 receptor, α subunit/interleukin 6 receptor); IL6ST (Interleukin-6 receptor, β subunit/interleukin 6 signal transducer); Interleukin-11 receptor, α subunit; Interleukin 27 receptor, alpha; Interleukin-31 receptor, α subunit; Ciliary neurotrophic factor receptor α subunit; Leukemia inhibitory factor receptor; Oncostatin M-specific receptor, β subunit; and the like. The amino acid sequences of such examples are provided in FIG. 55.

Non-limiting examples of IL-12 family receptors include Interleukin-12 receptor, β1 subunit; Interleukin-12 receptor, β2 subunit; Interleukin 23 receptor; and the like. The amino acid sequences of such examples are provided in FIG. 56.

Non-limiting examples of prolactin family receptors include Eythropoietin receptor; Granulocyte colony-stimulating factor receptor; Growth hormone receptor; Prolactin receptor; Thrombopoietin receptor; and the like. The amino acid sequences of such examples are provided in FIG. 57.

Non-limiting examples of interferon family receptors include interferon α/β receptor 1; Interferon α/β receptor 2; Interferon γ receptor 1; Interferon γ receptor 2; and the like. The amino acid sequences of such examples are provided in FIG. 58.

Non-limiting examples of IL-10 family receptors include Interleukin-22 receptor α2; Interleukin 10 receptor, α subunit; Interleukin 10 receptor, β subunit; Interleukin 20 receptor, α subunit; Interleukin 20 receptor, β subunit; Interleukin 22 receptor, α1 subunit; Interferon-λ receptor subunit 1; and the like. The amino acid sequences of such examples are provided in FIG. 59.

Non-limiting examples of IL-17 family receptors include Interleukin 17 receptor A; Interleukin 17 receptor B; interleukin 17 receptor C; Interleukin-17 receptor D; Interleukin 17 receptor E; and the like. The amino acid sequences of such examples are provided in FIG. 60.

Non-limiting examples of immunoglobulin-like superfamily receptors include Interleukin 1 receptor, type I; Interleukin 1 receptor, type II; Interleukin-1 receptor-like 1; Interleukin-1 receptor-like 2; Interleukin-18 1; IL-1 receptor accessory protein; IL-18 receptor accessory protein; PDGFRα (platelet derived growth factor receptor alpha); PDGFRβ (platelet derived growth factor receptor beta); KIT proto-oncogene receptor tyrosine kinase; CSFR (colony stimulating factor 1 receptor); and the like. The amino acid sequences of such examples are provided in FIG. 61.

Non-limiting examples of tumor necrosis factor family receptors include TNFR1 (tumor necrosis factor receptor 1/TNFRSF1A); TNFR2 (tumor necrosis factor receptor 2/TNFRSF1B); lymphotoxin β receptor/TNFRSF3; OX40/TNFRSF4; CD40/TNFRSF5; Fas/TNFRSF6; decoy receptor 3/TNFRSF6B; CD27/TNFRSF7; CD30/TNFRSF8; 4-1BB/TNFRSF9; DR4 (death receptor 4/TNFRSF10A); DR5 (death receptor 5/TNFRSF10B); decoy receptor 1/TNFRSF10C; decoy receptor 2/TNFRSF10D; RANK (receptor activator of NF-kappa B/TNFRSF11A); OPG (osteoprotegerin/TNFRSF11B); DR3 (death receptor 3/TNFRSF25); TWEAK receptor/TNFRSF12A; TACI/TNFRSF13B; BAFF-R (BAFF receptor/TNFRSF13C); HVEM (herpes virus entry mediator/TNFRSF14); nerve growth factor receptor/TNFRSF16; BCMA (B cell maturation antigen/TNFRSF17); GITR (glucocorticoid-induced TNF receptor/TNFRSF18); TAJ (toxicity and JNK inducer/TNFRSF19); RELT/TNFRSF19L; DR6 (death receptor 6/TNFRSF21); TNFRSF22; TNFRSF23; ectodysplasin A2 isoform receptor/TNFRS27; ectodysplasin 1, anhidrotic receptor; and the like. The amino acid sequences of such examples are provided in FIG. 62.

Non-limiting examples of chemokine receptors include CCR1; CCR2; CCR3; CCR4; CCR5; CCR6; CCR7; CCR8; CCR9; CCR10; CXCR1 (IL8Ra); CXCR2 (IL8Rb); CXCR3; CXCR4; CXCR5; CXCR6; CX3CR1; and the like. The amino acid sequences of such examples are provided in FIG. 63.

Non-limiting examples of TGF-beta family receptors include transforming growth factor beta, receptor type I (TGFBR1 (ALK5)); transforming growth factor beta, receptor type II (TGFBR2 (MFS2)) and transforming growth factor beta, receptor type III (TGFBR3 (β-Glycan)). The amino acid sequences of such examples are provided in FIG. 64.

Receptor Tyrosine Kinases

As noted above, useful non-limiting examples of dimerization-dependent cell-surface receptors include receptor tyrosine kinases (RTKs), including e.g., RTKs that form homodimers and RTKs that form heterodimers. Useful RTKs include but are not limited to e.g., MERTK (RefSeq Accession NP_006334); LMTK3 (RefSeq Accession NP_001073903); CSF1R (RefSeq Accession NP_001275634); EGFR (RefSeq Accession NP_005219); EPHA2 (RefSeq Accession NP_004422); EPHA1 (RefSeq Accession NP_005223); EPHA3 (RefSeq Accession NP_005224); EPHA4 (RefSeq Accession NP_001291465); EPHA5 (RefSeq Accession NP_004430); EPHA7 (RefSeq Accession NP_004431); EPHA8 (RefSeq Accession NP_065387); EPHB1 (RefSeq Accession NP_004432); EPHB2 (RefSeq Accession NP_001296122); EPHB3 (RefSeq Accession NP_004434); EPHB4 (RefSeq Accession NP_004435); EPHB6 (RefSeq Accession NP_004436); ERBB2 (RefSeq Accession NP_004439); ERBB3 (RefSeq Accession NP_001973); ERBB4 (RefSeq Accession NP_005226); FGFR1 (RefSeq Accession NP_075598); FGFR3 (RefSeq Accession NP_000133); FGFR2 (RefSeq Accession NP_000132); FGFR4 (RefSeq Accession NP_002002); LMTK2 (RefSeq Accession NP_055731); FLT1 (RefSeq Accession NP_002010); FLT3 (RefSeq Accession NP_004110); FLT4 (RefSeq Accession NP_891555); ALK (RefSeq Accession NP_004295); EPHA10 (RefSeq Accession NP_001092909); EPHA6 (RefSeq Accession NP_001265229); IGF1R (RefSeq Accession NP_000866); INSR (RefSeq Accession NP_000199); INSRR (RefSeq Accession NP_055030); KDR (RefSeq Accession NP_002244); KIT (RefSeq Accession NP_000213); LTK (RefSeq Accession NP_002335); MET (RefSeq Accession NP_000236); MST1R (RefSeq Accession NP_002438); MUSK (RefSeq Accession NP_005583); NTRK1 (RefSeq Accession NP_002520); NTRK2 (RefSeq Accession NP_001018074); NTRK3 (RefSeq Accession NP_001012338); ROR1 (RefSeq Accession NP_005003); ROR2 (RefSeq Accession NP_004551); DDR2 (RefSeq Accession NP_001014796); PDGFRA (RefSeq Accession NP_006197); PDGFRB (RefSeq Accession NP_002600); AXL (RefSeq Accession NP_068713); PTK7 (RefSeq Accession NP_002812); RET (RefSeq Accession NP_066124); ROS1 (RefSeq Accession NP_002935); RYK (RefSeq Accession NP_002949); TEK (RefSeq Accession NP_000450); TIE1 (RefSeq Accession NP_005415); TYRO3 (RefSeq Accession NP_006284); DDR1 (RefSeq Accession NP_001284583); AATK (RefSeq Accession NP_001073864); and the like. The amino acid sequences of such examples are provided in FIG. 65.

Dimerization Pairs

As noted above, conditionally active dimerization-dependent cell-surface receptor of the present disclosure will generally include a cell-surface receptor polypeptide that comprises a first member of a dimerization pair that is conditionally dimerizable with a second cell-surface receptor polypeptide that comprises the second member of a dimerization pair. Thus, a conditionally active dimerization-dependent cell-surface receptor of the present disclosure will comprise a member of a dimerization pair that includes a LBD of a nuclear hormone receptor or a co-regulator peptide. Two conditionally active dimerization-dependent cell-surface receptors may be utilized as a system where one conditionally active dimerization-dependent cell-surface receptor comprises a first member of a dimerization pair that includes a LBD of a nuclear hormone receptor and the other conditionally active dimerization-dependent cell-surface receptor comprises the second member of the dimerization pair that includes a co-regulator peptide of the same nuclear hormone receptor. In the presence of a dimerization agent (e.g., a nuclear hormone, or a functional derivative or analog of the nuclear hormone; also referred to herein as a "dimerizer"), the first and second members of the dimerization pair will bind to one another, and will effect dimerization of the two conditionally active dimerization-dependent cell-surface receptor polypeptides. A first member of a dimerization pair, or a second member of a dimerization pair, can also be referred to as a "dimerization domain".

A ligand-binding domain of a nuclear hormone receptor can be from any of a variety of nuclear hormone receptors, including, but not limited to, those described above. Suitable co-regulator polypeptides include full-length naturally-occurring nuclear hormone co-regulator polypeptides. Suitable co-regulator polypeptides include fragments of naturally-occurring nuclear hormone co-regulator polypeptides. Suitable co-regulator polypeptides include synthetic or recombinant nuclear hormone co-regulator polypeptides. Non-limiting examples of suitable co-regulator polypeptides include those described above.

Nucleic Acids

The present disclosure provides a nucleic acid that comprises a nucleotide sequence encoding a heterodimeric, conditionally active polypeptide of the present disclosure. A single nucleic acid molecule may include multiple sequences encoding two or more portions of a heterodimeric, conditionally active polypeptide of the present disclosure. In some instances, two or more portions of a heterodimeric, conditionally active polypeptide of the present disclosure may be separated across multiple individual nucleic acid molecules (e.g., multiple nucleic acid vectors). A nucleic acid comprising a nucleotide sequence encoding a heterodimeric, conditionally active polypeptide of the present disclosure will in some embodiments be DNA, including, e.g., a recombinant expression vector. A nucleic acid comprising a nucleotide sequence encoding a heterodimeric, conditionally active polypeptide of the present disclosure will in some embodiments be RNA, e.g., in vitro synthesized RNA.

In some cases, a nucleic acid of the present disclosure comprises a nucleotide sequence encoding only a first portion, e.g., a first polypeptide chain of a heterodimeric, conditionally active polypeptide of the present disclosure. In some cases, a nucleic acid of the present disclosure comprises a nucleotide sequence encoding only a second portion, e.g., a second polypeptide chain, of a heterodimeric, conditionally active polypeptide of the present disclosure. In some cases, a nucleic acid of the present disclosure comprises a nucleotide sequence encoding both polypeptide chains of a heterodimeric, conditionally active polypeptide of the present disclosure.

In some cases, a single nucleic acid of the present disclosure may comprise one or more nucleotide sequences encoding two or more conditionally active polypeptides of the present disclosure. For example, in some instances, a nucleic acid of the present disclosure may encode a first conditionally active polypeptide comprising a first member of a dimerization pair and a second conditionally active polypeptide comprising the second member of a dimerization pair. In some embodiments, a nucleic acid of the present disclosure may comprise a sequence or multiple sequences that encode a first conditionally active dimerization-dependent cell-surface receptor comprising a first member of a dimerization pair and a second conditionally active dimerization-dependent cell-surface receptor comprising the second member of a dimerization pair. In some embodiments, two conditionally active dimerization-dependent cell-surface receptors, although each containing half of a dimerization pair, may be encoded by sequences present on separate nucleic acids.

In some cases, a subject nucleic acid provides for production of a heterodimeric, conditionally active polypeptide of the present disclosure, e.g., in a mammalian cell. In other cases, a subject nucleic acid provides for amplification of the heterodimeric, conditionally active polypeptide-encoding nucleic acid.

A nucleotide sequence encoding a heterodimeric, conditionally active polypeptide of the present disclosure can be operably linked to a transcriptional control element, e.g., a promoter, and enhancer, etc. In some instances, the heterodimeric, conditionally active polypeptide encoding nucleic acid is operably linked to a tissue specific promoter for expression in a particular cell type of interest. For example, a heterodimeric, conditionally active polypeptide may be operably linked to an immune cell specific promoter for specific expression in one or more immune cell types. In other instances, a heterodimeric, conditionally active polypeptide may be operably linked to a general (i.e., non-immune cell specific) promoter including e.g., a ubiquitous promoter, a constitutive promoter, a heterologous promoter, a regulatable promoters (e.g., inducible promoters, reversible promoters, etc.), etc.

General Promoters

Suitable promoter and enhancer elements are known in the art. For expression in a bacterial cell, suitable promoters include, but are not limited to, lad, lacZ, T3, T7, gpt, lambda P and trc. For expression in a eukaryotic cell, suitable promoters include, but are not limited to; cytomegalovirus immediate early promoter; herpes simplex virus thymidine kinase promoter; early and late SV40 promoters; promoter present in long terminal repeats from a retrovirus; mouse metallothionein-I promoter; and various art-known promoters.

Suitable promoters for use in prokaryotic host cells include, but are not limited to, a bacteriophage T7 RNA polymerase promoter; a trp promoter; a lac operon promoter; a hybrid promoter, e.g., a lac/tac hybrid promoter, a tac/trc hybrid promoter, a trp/lac promoter, a T7/lac promoter; a trc promoter; a tac promoter, and the like; an araBAD promoter; in vivo regulated promoters, such as an ssaG promoter or a related promoter (see, e.g., U.S. Patent Publication No. 20040131637), a pagC promoter (Pulkkinen and Miller, J. Bacteriol., 1991: 173(1): 86-93; Alpuche-Aranda et al., PNAS, 1992; 89(21): 10079-83), a nirB promoter (Harborne et al. (1992) Mol. Micro. 6:2805-2813), and the like (see, e.g., Dunstan et al. (1999) Infect. Immun 67:5133-5141; McKelvie et al. (2004) Vaccine 22:3243-3255; and Chatfield et al. (1992) Biotechnol. 10:888-892); a sigma70 promoter, e.g., a consensus sigma70 promoter (see, e.g., GenBank Accession Nos. AX798980, AX798961, and AX798183); a stationary phase promoter, e.g., a dps promoter, an spy promoter, and the like; a promoter derived from the pathogenicity island SPI-2 (see, e.g., WO96/17951); an actA promoter (see, e.g., Shetron-Rama et al. (2002) Infect. Immun 70:1087-1096); an rpsM promoter (see, e.g., Valdivia and Falkow (1996). Mol. Microbiol. 22:367); a tet promoter (see, e.g., Hillen, W. and Wissmann, A. (1989) In Saenger, W. and Heinemann, U. (eds), Topics in Molecular and Structural Biology, Protein—Nucleic Acid Interaction. Macmillan, London, UK, Vol. 10, pp. 143-162); an SP6 promoter (see, e.g., Melton et al. (1984) Nucl. Acids Res. 12:7035); and the like. Suitable strong promoters for use in prokaryotes such as *Escherichia coli* include, but are not limited to Trc, Tac, T5, T7, and PLambda. Non-limiting examples of operators for use in bacterial host cells include a lactose promoter operator (LacI repressor protein changes conformation when contacted with lactose, thereby preventing the Lad repressor protein from binding to the operator), a tryptophan promoter operator (when complexed with tryptophan, TrpR repressor protein has a conformation that binds the operator; in the absence of tryptophan, the TrpR repressor protein has a conformation that does not bind to the operator), and a tac promoter operator (see, for example, deBoer et al. (1983) Proc. Natl. Acad. Sci. U.S.A. 80:21-25).

Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

In some embodiments, e.g., for expression in a yeast cell, a suitable promoter is a constitutive promoter such as an ADH1 promoter, a PGK1 promoter, an ENO promoter, a PYK1 promoter and the like; or a regulatable promoter such as a GAL1 promoter, a GAL10 promoter, an ADH2 promoter, a PHO5 promoter, a CUP1 promoter, a GAL7 promoter, a MET25 promoter, a MET3 promoter, a CYC1 promoter, a HIS3 promoter, an ADH1 promoter, a PGK promoter, a GAPDH promoter, an ADC1 promoter, a TRP1 promoter, a URA3 promoter, a LEU2 promoter, an ENO promoter, a TP1 promoter, and AOX1 (e.g., for use in *Pichia*). Selection of the appropriate vector and promoter is well within the level of ordinary skill in the art.

Immune Cell Promoters

In some instances, nucleic acids of the present disclosure include immune cell specific promoters that are expressed in one or more immune cell types, including but not limited to lymphocytes, hematopoietic stem cells and/or progeny thereof (i.e., immune cell progenitors), etc. Any convenient and appropriate promoter of an immune cell specific gene may find use in nucleic acids of the present disclosure. In some instances, an immune cell specific promoter of a nucleic acid of the present disclosure may be a T cell specific promoter. In some instances, an immune cell specific promoter of a nucleic acid of the present disclosure may be a light and/or heavy chain immunoglobulin gene promoter and may or may not include one or more related enhancer elements.

In some instances, an immune cell specific promoter of a nucleic acid of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9 γ (TRGV9) gene promoter, a V2 δ (TRDV2) gene promoter, and the like.

In some instances, an immune cell specific promoter of a nucleic acid of the present disclosure may be a viral promoter expressed in immune cells. As such, in some instances, viral promoters useful in nucleic acids of the present disclosure include viral promoters derived from immune cells viruses, including but not limited to, e.g., lentivirus promoters (e.g., HIV, SIV, FIV, EIAV, or Visna promoters) including e.g., LTR promoter, etc., Retroviridae promoters including, e.g., HTLV-I promoter, HTLV-II promoter, etc., and the like.

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) Proc. Natl. Acad. Sci. USA 90:7739; and Marodon et al. (2003) Blood 101:3416. As another example, a CD8 gene promoter can be used. NK cell-specific expression can be achieved by use of an Ncrl (p46) promoter; see, e.g., Eckelhart et al. (2011) Blood 117:1565.

Additional Nucleic Acid Components, Constructs and Use Thereof

In some instances, the locus or construct or transgene containing the suitable promoter is irreversibly switched through the induction of an inducible system. Suitable systems for induction of an irreversible switch are well known in the art, e.g., induction of an irreversible switch may make use of a Cre-lox-mediated recombination (see, e.g., Fuhrmann-Benzakein, et al., PNAS (2000) 28:e99, the disclosure of which is incorporated herein by reference). Any suitable combination of recombinase, endonuclease, ligase, recombination sites, etc. known to the art may be used in generating an irreversibly switchable promoter. Methods, mechanisms, and requirements for performing site-specific recombination, described elsewhere herein, find use in generating irreversibly switched promoters and are well known in the art, see, e.g., Grindley et al. (2006) Annual Review of Biochemistry, 567-605 and Tropp (2012) Molecular Biology (Jones & Bartlett Publishers, Sudbury, Mass.), the disclosures of which are incorporated herein by reference.

A nucleotide sequence encoding a subject heterodimeric, conditionally active polypeptide can be present in an expression vector and/or a cloning vector. Where a subject heterodimeric, conditionally active polypeptide is split between two or more separate polypeptides, nucleotide sequences encoding the two or more polypeptides can be cloned in the same or separate vectors. An expression vector can include a selectable marker, an origin of replication, and other features that provide for replication and/or maintenance of the vector. Suitable expression vectors include, e.g., plasmids, viral vectors, and the like.

Large numbers of suitable vectors and promoters are known to those of skill in the art; many are commercially available for generating a subject recombinant constructs. The following vectors are provided by way of example. Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWLneo, pSV2cat, pOG44, PXR1, pSG (Stratagene) pSVK3, pBPV, pMSG and pSVL (Pharmacia).

Expression vectors generally have convenient restriction sites located near the promoter sequence to provide for the insertion of nucleic acid sequences encoding heterologous proteins. A selectable marker operative in the expression host may be present. Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

As noted above, in some embodiments, a nucleic acid comprising a nucleotide sequence encoding a heterodimeric, conditionally active polypeptide of the present disclosure will in some embodiments be RNA, e.g., in vitro synthesized RNA. Methods for in vitro synthesis of RNA are known in the art; any known method can be used to synthesize RNA comprising a nucleotide sequence encoding the first and/or the second polypeptide of a heterodimeric, conditionally active polypeptide of the present disclosure. Methods for introducing RNA into a host cell are known in the art. See, e.g., Zhao et al. (2010) Cancer Res. 15:9053. Introducing RNA comprising a nucleotide sequence encoding the first and/or the second polypeptide of a heterodimeric, conditionally active polypeptide of the present disclosure into a host cell can be carried out in vitro or ex vivo or in vivo. For example, a host cell (e.g., an NK cell, a cytotoxic T lymphocyte, etc.) can be electroporated in vitro or ex vivo with RNA comprising a nucleotide sequence encoding the first and/or the second polypeptide of a heterodimeric, conditionally active polypeptide of the present disclosure.

Cells

The present disclosure provides a mammalian cell that is genetically modified to produce a heterodimeric, conditionally active polypeptide of the present disclosure.

Suitable mammalian cells include primary cells and immortalized cell lines. Suitable mammalian cell lines include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, Hut-78, Jurkat, HL-60, NK cell lines (e.g., NKL, NK92, and YTS), and the like.

In some instances, suitable cells include those described in Themeli et al. Cell Stem Cell. 2015 Apr. 2; 16(4):357-66; the disclosure of which is incorporated herein by reference in its entirety.

In some instances, the cell is not an immortalized cell line, but is instead a cell (e.g., a primary cell) obtained from an individual. For example, in some cases, the cell is an immune cell, immune cell progenitor or immune stem cell obtained from an individual. As an example, the cell is a T lymphocyte, or progenitor thereof, obtained from an individual. As another example, the cell is a cytotoxic cell, or progenitor thereof, obtained from an individual. As another example, the cell is a stem cell or progenitor cell obtained from an individual.

Utility

A heterodimeric, conditionally active polypeptide of the present disclosure finds use in a variety of research and treatment methods, which are provided herein.

In some cases, where a heterodimeric, conditionally active polypeptide of the present disclosure comprises a first heterologous polypeptide and a second heterologous polypeptide that individually do not exhibit an activity but do exhibit the activity when present in a heterodimeric, conditionally active polypeptide of the present disclosure and in the presence of a dimerization agent that induces binding of the LBD to the co-regulator peptide in the heterodimeric, conditionally active polypeptide, the present disclosure provides a method of activating the activity. Thus, e.g., the present disclosure provides a method of activating a polypeptide (inducing an activity of a polypeptide), the method comprising contacting a heterodimeric, conditionally active polypeptide of the present disclosure with a dimerization agent, where the polypeptide is present in the heterodimeric polypeptide as a first heterologous polypeptide and a second heterologous polypeptide, where the first heterologous polypeptide and a second heterologous polypeptide that individually do not exhibit an activity but do exhibit the activity when present in a heterodimeric, conditionally active polypeptide of the present disclosure and in the presence of the dimerization agent. The activity that is induced depends on the nature of the first heterologous polypeptide and a second heterologous polypeptide. For example, where the first heterologous polypeptide and a second heterologous polypeptide are a receptor and a co-receptor, respectively, the activity can be binding of the receptor to the co-receptor, or a downstream activity that results from binding of the receptor to the co-receptor. In some cases, contacting a heterodimeric, conditionally active polypeptide of the present disclosure occurs in vitro, where the heterodimeric, conditionally active polypeptide of the present disclosure is not in a cell. In some cases, contacting a heterodimeric, conditionally active polypeptide of the present disclosure occurs in a cell in vitro, where the heterodimeric, conditionally active polypeptide of the present disclosure is in the cell. In some cases, contacting a heterodimeric, conditionally active polypeptide of the present disclosure occurs in a cell in vivo, where the heterodimeric, conditionally active polypeptide of the present disclosure is in the cell.

Methods for Modulating the Activity of a Cell

The present disclosure provides methods for modulating (activating; repressing) an activity of a cell. The methods generally involve contacting a cell that expresses a heterodimeric, conditionally active polypeptide of the present disclosure with a dimerizing agent. In some cases, the methods involve contacting a cell that expresses a heterodimeric, conditionally active polypeptide of the present disclosure with a dimerizing agent and a second agent (e.g., an antigen).

Methods of Activating an Immune Cell

The present disclosure provides methods of activating an immune cell, where the immune cell expresses an On-switch CAR of the present disclosure. The present disclosure provides methods of activating an immune cell in vitro, in vivo, or ex vivo. The methods generally involve contacting an immune cell (in vitro, in vivo, or ex vivo) with a dimerizing agent and an antigen, where the immune cell is genetically modified to produce a heterodimeric, conditionally active CAR of the present disclosure. In the presence of the dimerizing agent and the antigen, the heterodimeric, conditionally active CAR dimerizes and activates the immune cell, thereby producing an activated immune cell Immune cells include, e.g., a cytotoxic T lymphocyte, an NK cell, a $CD4^+$ T cell, a T regulatory (Treg) cell, etc.

Contacting the genetically modified immune cell (e.g., a T lymphocyte, an NK cell) with a dimerizing agent and a second member of a specific binding pair (e.g., an antigen, a ligand, a receptor) can increase production of a cytokine by the immune cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of cytokine produced by the immune cell in the absence of the second member of a specific binding pair and/or the dimerizing agent. Cytokines whose production can be increased include, but are not limited to, IL-2 and IFN-γ.

Contacting the genetically modified immune cell (e.g., a T lymphocyte, an NK cell) with a dimerizing agent and an antigen can increase production of a cytokine by the immune cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of cytokine produced by the immune cell in the absence of the antigen and/or the dimerizing agent. Cytokines whose production can be increased include, but are not limited to, IL-2 and IFN-γ.

Contacting a genetically modified cytotoxic cell (e.g., cytotoxic T lymphocyte) with a dimerizing agent and a second member of a specific binding pair (e.g., an antigen, a ligand, a receptor) can increase cytotoxic activity of the cytotoxic cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared to the cytotoxic activity of the cytotoxic cell in the absence of the dimerizing agent.

Contacting a genetically modified cytotoxic cell (e.g., cytotoxic T lymphocyte) with a dimerizing agent and an antigen can increase cytotoxic activity of the cytotoxic cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared to the cytotoxic activity of the cytotoxic cell in the absence of the dimerizing agent.

In other embodiments, e.g., depending on the host immune cell, contacting a genetically modified host cell with a dimerizing agent and an antigen can increase or decrease cell proliferation, cell survival, cell death, and the like.

The present disclosure provides a method of generating a conditionally activatable cell. The method generally involves genetically modifying a mammalian cell with an expression vector, or an RNA (e.g., in vitro transcribed RNA), comprising nucleotide sequences encoding a heterodimeric, conditionally active CAR of the present disclosure. The genetically modified cell is conditionally activatable in the presence of: a) an antigen to which the first polypeptide of the CAR binds; and b) a dimerizer (a dimerizing agent). The genetic modification can be carried out in vivo, in vitro, or ex vivo. The cell can be an immune cell (e.g., a T lymphocyte or NK cell), a stem cell, a progenitor cell, etc.

In some cases, the genetic modification is carried out ex vivo. For example, a T lymphocyte, a stem cell, or an NK cell is obtained from an individual; and the cell obtained from the individual is genetically modified to express a CAR of the present disclosure. The genetically modified cell is conditionally activatable in the presence of: a) an antigen to which the first polypeptide of the CAR binds; and b) a dimerizer. In some cases, the genetically modified cell is activated ex vivo. In other cases, the genetically modified cell is introduced into an individual (e.g., the individual from whom the cell was obtained); and the genetically modified cell is activated in vivo, e.g., by administering to the individual a dimerizer. For example, where the antigen is present on the surface of a cell in the individual, there is no need to administer the antigen. The genetically modified cell comes into contact with the antigen present on the surface of a cell in the individual; and, upon administration to the individual of a dimerizer, the genetically modified cell is activated. For example, where the genetically modified cell is a T lymphocyte, the genetically modified cell can exhibit cytotoxicity toward a cell that presents an antigen on its surface to which the CAR binds.

Methods of Repressing Immune Cell Activation

The present disclosure provides methods of repressing immune cell activation, such methods being applicable in vitro, in vivo, or ex vivo. The methods generally involve contacting an immune cell (in vitro, in vivo, or ex vivo) with a dimerizing agent, where the immune cell is genetically modified to produce a heteromeric, conditionally repressible synthetic ICR of the present disclosure. In the presence of the dimerizing agent, the heteromeric, conditionally repressible ICR dimerizes and represses activation of the immune cell, thereby producing a repressed immune cell. Immune cells include, e.g., a cytotoxic T lymphocyte, an NK cell, a CD4+ T cell, a T regulatory (Treg) cell, etc.

Contacting the genetically modified immune cell (e.g., a T lymphocyte, an NK cell) with a dimerizing agent can repress the expression of a lymphocyte cell surface antigen, e.g., a cell surface antigen indicative of immune cell activation, T cell activation, etc., by the immune cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of the cell surface antigen expressed by the activated immune cell in the absence of the dimerizing agent. Lymphocyte cell surface antigens whose production can be repressed include, but are not limited to e.g., CD69.

Contacting the genetically modified immune cell (e.g., a T lymphocyte, an NK cell) with a dimerizing agent can repress the production of a cytokine by the immune cell by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of cytokine produced by the activated immune cell in the absence of the dimerizing agent. Cytokines whose production can be repressed include, but are not limited to, IL-2 and IFN-γ.

Formulations, Dosages, and Routes of Administration

As discussed above, a treatment method of the present disclosure involves administration to an individual in need thereof of an effective amount of a dimerizer agent, and may also involve administration of an antigen.

An "effective amount" of a dimerizer agent is in some cases an amount that, when administered in one or more doses to an individual in need thereof, increases the level of cytotoxic activity of a T lymphocyte expressing a subject CAR by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared to the cytotoxic activity of the T lymphocyte in the absence of the dimerizing agent.

An "effective amount" of a dimerizer agent is in some cases an amount that, when administered in one or more doses to an individual in need thereof, increases the level of cytotoxic activity of an NK cell expressing a subject CAR by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared to the cytotoxic activity of the NK cell in the absence of the dimerizing agent.

An "effective amount" of a dimerizer agent is in some cases an amount that, when administered in one or more doses to an individual in need thereof, reduces the number of cancer cells in the individual and/or reduces tumor mass in the individual, by at least about 10%, at least about 15%, at least about 20%, at least about 25%, at least about 30%, at least about 40%, at least about 50%, at least about 75%, or more than 75%, compared to the number of cancer cells and/or tumor mass in the absence of the dimerizing agent.

In some embodiments, an effective amount of a dimerizer is an amount that, when administered alone (e.g., in monotherapy) or in combination (e.g., in combination therapy) with one or more additional therapeutic agents, in one or more doses, is effective to reduce one or more of tumor growth rate, cancer cell number, and tumor mass, by at least about 5%, at least about 10%, at least about 15%, at least about 20%, at least about 25%, at least about 30%, at least about 40%, at least about 50%, at least about 60%, at least about 70%, at least about 80%, at least about 90%, or more, compared to the tumor growth rate, cancer cell number, or tumor mass in the absence of treatment with the dimerizer.

Formulations

In the subject methods, a dimerizer can be administered to the host using any convenient means capable of resulting in the desired therapeutic effect or diagnostic effect. Thus, the dimerizer can be incorporated into a variety of formulations for therapeutic administration. More particularly, a dimerizer can be formulated into pharmaceutical compositions by combination with appropriate, pharmaceutically acceptable carriers or diluents, and may be formulated into preparations in solid, semi-solid, liquid or gaseous forms, such as tablets, capsules, powders, granules, ointments, solutions, suppositories, injections, inhalants and aerosols.

In pharmaceutical dosage forms, a dimerizer can be administered in the form of their pharmaceutically acceptable salts, or they may also be used alone or in appropriate association, as well as in combination, with other pharmaceutically active compounds. The following methods and excipients are merely exemplary and are in no way limiting.

Suitable excipient vehicles are, for example, water, saline, dextrose, glycerol, ethanol, or the like, and combinations thereof. In addition, if desired, the vehicle may contain minor amounts of auxiliary substances such as wetting or emulsifying agents or pH buffering agents. Actual methods of preparing such dosage forms are known, or will be apparent, to those skilled in the art. See, e.g., Remington's Pharmaceutical Sciences, Mack Publishing Company, Easton, Pa., 17th edition, 1985. The composition or formulation to be administered will, in any event, contain a quantity of a dimerizer adequate to achieve the desired state in the subject being treated.

The pharmaceutically acceptable excipients, such as vehicles, adjuvants, carriers or diluents, are readily available to the public. Moreover, pharmaceutically acceptable auxiliary substances, such as pH adjusting and buffering agents, tonicity adjusting agents, stabilizers, wetting agents and the like, are readily available to the public.

For oral preparations, a dimerizer can be used alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives and flavoring agents.

A dimerizer can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

Pharmaceutical compositions comprising a dimerizer are prepared by mixing the dimerizer having the desired degree of purity with optional physiologically acceptable carriers, excipients, stabilizers, surfactants, buffers and/or tonicity agents. Acceptable carriers, excipients and/or stabilizers are nontoxic to recipients at the dosages and concentrations employed, and include buffers such as phosphate, citrate, and other organic acids; antioxidants including ascorbic acid, glutathione, cysteine, methionine and citric acid; preservatives (such as ethanol, benzyl alcohol, phenol, m-cresol, p-chlor-m-cresol, methyl or propyl parabens, benzalkonium chloride, or combinations thereof); amino acids such as arginine, glycine, ornithine, lysine, histidine, glutamic acid, aspartic acid, isoleucine, leucine, alanine, phenylalanine, tyrosine, tryptophan, methionine, serine, proline and combinations thereof; monosaccharides, disaccharides and other carbohydrates; low molecular weight (less than about 10 residues) polypeptides; proteins, such as gelatin or serum albumin; chelating agents such as EDTA; sugars such as trehalose, sucrose, lactose, glucose, mannose, maltose, galactose, fructose, sorbose, raffinose, glucosamine, N-methylglucosamine, galactosamine, and neuraminic acid; and/or non-ionic surfactants such as Tween, Brij Pluronics, Triton-X, or polyethylene glycol (PEG).

The pharmaceutical composition may be in a liquid form, a lyophilized form or a liquid form reconstituted from a lyophilized form, wherein the lyophilized preparation is to be reconstituted with a sterile solution prior to administration. The standard procedure for reconstituting a lyophilized composition is to add back a volume of pure water (typically equivalent to the volume removed during lyophilization); however solutions comprising antibacterial agents may be used for the production of pharmaceutical compositions for parenteral administration; see also Chen (1992) Drug Dev Ind Pharm 18, 1311-54.

The term "unit dosage form," as used herein, refers to physically discrete units suitable as unitary dosages for human and animal subjects, each unit containing a predetermined quantity a dimerizer calculated in an amount sufficient to produce the desired effect in association with a pharmaceutically acceptable diluent, carrier or vehicle. The specifications for a given dimerizer may depend on the particular dimerizer employed and the effect to be achieved, and the pharmacodynamics associated with each dimerizer in the host.

In some embodiments, a dimerizer is formulated in a controlled release formulation. Sustained-release preparations may be prepared using methods well known in the art. Suitable examples of sustained-release preparations include semipermeable matrices of solid hydrophobic polymers containing the dimerizer in which the matrices are in the form of shaped articles, e.g. films or microcapsules. Examples of sustained-release matrices include polyesters, copolymers of L-glutamic acid and ethyl-L-glutamate, non-degradable ethylene-vinyl acetate, hydrogels, polylactides, degradable lactic acid-glycolic acid copolymers and poly-D-(-)-3-hydroxybutyric acid. Possible loss of biological activity may be prevented by using appropriate additives, by controlling moisture content and by developing specific polymer matrix compositions.

Dosages

A suitable dosage can be determined by an attending physician or other qualified medical personnel, based on various clinical factors. As is well known in the medical arts, dosages for any one patient depend upon many factors, including the patient's size, body surface area, age, the particular dimerizer to be administered, sex of the patient, time, and route of administration, general health, and other drugs being administered concurrently. A dimerizer may be administered in amounts between 1 ng/kg body weight and 20 mg/kg body weight per dose, e.g. between 0.1 mg/kg body weight to 10 mg/kg body weight, e.g. between 0.5 mg/kg body weight to 5 mg/kg body weight; however, doses below or above this exemplary range are envisioned, especially considering the aforementioned factors. If the regimen is a continuous infusion, it can also be in the range of 1 μg to 10 mg per kilogram of body weight per minute.

Those of skill will readily appreciate that dose levels can vary as a function of the specific dimerizer, the severity of the symptoms and the susceptibility of the subject to side effects. Preferred dosages for a given compound are readily determinable by those of skill in the art by a variety of means.

Routes of Administration

A dimerizer is administered to an individual using any available method and route suitable for drug delivery, including in vivo and ex vivo methods, as well as systemic and localized routes of administration.

Conventional and pharmaceutically acceptable routes of administration include intratumoral, peritumoral, intramuscular, intratracheal, intracranial, subcutaneous, intradermal, topical application, intravenous, intraarterial, rectal, nasal, oral, and other enteral and parenteral routes of administration. Routes of administration may be combined, if desired, or adjusted depending upon the dimerizer and/or the desired effect. A dimerizer can be administered in a single dose or in multiple doses. In some embodiments, a dimerizer is administered orally. In some embodiments, a dimerizer is administered via an inhalational route. In some embodiments, a dimerizer is administered intranasally. In some embodiments, a dimerizer is administered locally. In some embodiments, a dimerizer is administered intratumorally. In some embodiments, a dimerizer is administered peritumorally. In some embodiments, a dimerizer is administered intracranially. In some embodiments, a dimerizer is administered intravenously.

The agent can be administered to a host using any available conventional methods and routes suitable for delivery of conventional drugs, including systemic or localized routes. In general, routes of administration contemplated by the invention include, but are not necessarily limited to, enteral, parenteral, or inhalational routes.

Parenteral routes of administration other than inhalation administration include, but are not necessarily limited to, topical, transdermal, subcutaneous, intramuscular, intraorbital, intracapsular, intraspinal, intrasternal, intratumoral, peritumoral, and intravenous routes, i.e., any route of administration other than through the alimentary canal. Parenteral administration can be carried to effect systemic or local delivery of a dimerizer. Where systemic delivery is desired, administration typically involves invasive or systemically absorbed topical or mucosal administration of pharmaceutical preparations.

A dimerizer can also be delivered to the subject by enteral administration. Enteral routes of administration include, but are not necessarily limited to, oral and rectal (e.g., using a suppository) delivery.

By treatment is meant at least an amelioration of the symptoms associated with the pathological condition afflicting the host, where amelioration is used in a broad sense to refer to at least a reduction in the magnitude of a parameter, e.g. symptom, associated with the pathological condition being treated, such as cancer. As such, treatment also includes situations where the pathological condition, or at least symptoms associated therewith, are completely inhibited, e.g. prevented from happening, or stopped, e.g. terminated, such that the host no longer suffers from the pathological condition, or at least the symptoms that characterize the pathological condition.

In some embodiments, a dimerizer is administered by injection and/or delivery, e.g., to a site in a brain artery or directly into brain tissue. A dimerizer can also be administered directly to a target site e.g., by direct injection, by implantation of a drug delivery device such as an osmotic pump or slow release particle, by biolistic delivery to the target site, etc.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-45 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. A heterodimeric, conditionally active polypeptide comprising: a) a first chimeric polypeptide comprising a first member of a dimerization pair and a first heterologous polypeptide; and b) a second chimeric polypeptide comprising a second member of a dimerization pair and a second heterologous polypeptide, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the first chimeric polypeptide and the second chimeric polypeptide are dimerized in the presence of a dimerization agent that induces binding of the LBD to the co-regulator.

2. The heterodimeric, conditionally active polypeptide of aspect 1, wherein: a) the first heterologous polypeptide is a T-cell receptor (TCR) alpha chain; and b) the second heterologous polypeptide is a TCR beta chain.

3. The heterodimeric, conditionally active polypeptide of aspect 1, wherein: a) the first heterologous polypeptide is a first polypeptide of a chimeric antigen receptor (CAR) heterodimer; and b) the second heterologous polypeptide is a second polypeptide of a CAR heterodimer.

4. The heterodimeric, conditionally active polypeptide of aspect 1, wherein: a) the first heterologous polypeptide is an N-terminal portion of an RNA-guided endonuclease; and b) the second heterologous polypeptide is a C-terminal portion of the RNA-guided endonuclease, wherein dimerization of the first chimeric polypeptide and the second chimeric polypeptide, mediated by the dimerization agent that induces binding of the LBD to the co-regulator, restores enzymatic function of the RNA-guided endonuclease.

5. The heterodimeric, conditionally active polypeptide of aspect 4, wherein the RNA-guided endonuclease is a class 2 CRISPR/Cas endonuclease.

6. The heterodimeric, conditionally active polypeptide of aspect 5, wherein the class 2 CRISPR/Cas endonuclease is a type II CRISPR/Cas protein, a type V CRISPR/Cas protein, or a type VI CRISPR/Cas protein.

7. The heterodimeric, conditionally active polypeptide of aspect 1, wherein: a) the first heterologous polypeptide is an N-terminal portion of an enzyme; and b) the second heterologous polypeptide is a C-terminal portion of the enzyme, wherein dimerization of the first chimeric polypeptide and the second chimeric polypeptide restore enzymatic activity of the enzyme.

8. The heterodimeric, conditionally active polypeptide of aspect 7, wherein the enzyme is a kinase, a protease, a phosphatase, or a caspase.

9. The heterodimeric, conditionally active polypeptide of aspect 1, wherein the first polypeptide and the second polypeptide exhibit an activity when brought into proximity upon dimerization mediated by the dimerization agent, but do not exhibit the activity individually.

10. The heterodimeric, conditionally active polypeptide of aspect 1, wherein a) the first heterologous polypeptide is an N-terminal portion of an antigen receptor; and b) the second heterologous polypeptide is a C-terminal portion of the antigen receptor, wherein dimerization of the first chimeric polypeptide and the second chimeric polypeptide restore signaling activity of the antigen receptor.

11. The heterodimeric, conditionally active polypeptide of aspect 1, wherein: a) the first heterologous polypeptide is an N-terminal portion of a receptor; and b) the second heterologous polypeptide is a C-terminal portion of the antigen receptor, wherein dimerization of the first chimeric polypeptide and the second chimeric polypeptide mediated by the dimerization agent restores signaling activity of the receptor.

12. The heterodimeric, conditionally active polypeptide of any one of aspects 1-11, wherein LBD of the nuclear hormone binding member of the dimerization pair is an LBD of a nuclear hormone receptor selected from an estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor.

13. The heterodimeric, conditionally active polypeptide of any one of aspects 1-12, wherein the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

14. The heterodimeric, conditionally active polypeptide of any one of aspects 1-12, wherein the co-regulator of the nuclear hormone receptor is selected from:

a) SRC1:
CPSSHSSLTERHKILHRLLQEGSPS; (SEQ ID NO: 1)

b) SRC1-2:
SLTARHKILHRLLQEGSPSDI; (SEQ ID NO: 2)

c) SRC3-1:
ESKGHKKLLQLLTCSSDDR; (SEQ ID NO: 3)

d) SRC3:
PKKENNALLRYLLDRDDPSDV; (SEQ ID NO: 4)

e) PGC-1:
AEEPSLLKKLLLAPANT; (SEQ ID NO: 5)

f) PGC1a:
QEAEEPSLLKKLLLAPANTQL; (SEQ ID NO: 6)

g) TRAP220-1:
SKVSQNPILTSLLQITGNGGS; (SEQ ID NO: 7)

h) NCoR (2051-2075):
GHSFADPASNLGLEDIIRKALMGSF; (SEQ ID NO: 8)

i) NR0B1:
PRQGSILYSMLTSAKQT; (SEQ ID NO: 9)

j) NRIP1:
AANNSLLLHLLKSQTIP; (SEQ ID NO: 10)

k) TIF2:
PKKKENALLRYLLDKDDTKDI; (SEQ ID NO: 11)

l) CoRNR Box:
DAFQLRQLILRGLQDD; (SEQ ID NO: 12)

m) αβV:
SPGSREWFKDMLS; (SEQ ID NO: 13)

n) TRAP220-2:
GNTKNHPMLMNLLKDNPAQDF; (SEQ ID NO: 14)

o) EA2:
SSKGVLWRMLAEPVSR; (SEQ ID NO: 15)

p) TA1:
SRTLQLDWGTLYWSR; (SEQ ID NO: 16)

q) EAB1:
SSNHQSSRLIELLSR; (SEQ ID NO: 17)

r) SRC2:
LKEKHKILHRLLQDSSSPV; (SEQ ID NO: 18)

s) SRC1-3:
QAQQKSLLQQLLTE; (SEQ ID NO: 19)

t) SRC1-1:
KYSQTSHKLVQLLTTTAEQQL; (SEQ ID NO: 20)

u) SRC1-2:
SLTARHKILHRLLQEGSPSDI; (SEQ ID NO: 21)

v) SRC1-3:
KESKDHQLLRYLLDKDEKDLR; (SEQ ID NO: 22)

w) SRC1-4a:
PQAQQKSLLQQLLTE; (SEQ ID NO: 23)

x) SRC1-4b:
PQAQQKSLRQQLLTE; (SEQ ID NO: 24)

y) GRIP1-1:
HDSKGQTKLLQLLTTKSDQME; (SEQ ID NO: 25)

z) GRIP1-2:
SLKEKHKILHRLLQDSSSPVD; (SEQ ID NO: 26)

aa) GRIP1-3:
PKKKENALLRYLLDKDDTKDI; (SEQ ID NO: 27)

bb) AIB1-1:
LESKGHKKLLQLLTCSSDDRG; (SEQ ID NO: 28)

cc) AIB1-2:
LLQEKHRILHKLLQNGNSPAE; (SEQ ID NO: 29)

dd) AIB1-3:
KKKENNALLRYLLDRDDPSDA; (SEQ ID NO: 30)

ee) PGC1a:
QEAEEPSLLKKLLLAPANTQL; (SEQ ID NO: 31)

ff) PGC1b:
PEVDELSLLQKLLLATSYPTS; (SEQ ID NO: 32)

gg) PRC:
VSPREGSSLHKLLTLSRTPPE; (SEQ ID NO: 33)

hh) TRAP220-1:
SKVSQNPILTSLLQITGNGGS; (SEQ ID NO: 34)

| | -continued | |
|---|---|---|
| ii) | TRAP220-2:<br>GNTKNHPMLMNLLKDNPAQDF; | (SEQ ID NO: 35) |
| jj) | ASC2-1:<br>DVTLTSPLLVNLLQSDISAGH; | (SEQ ID NO: 36) |
| kk) | ASC2-2:<br>AMREAPTSLSQLLDNSGAPNV; | (SEQ ID NO: 37) |
| ll) | CBP-1:<br>DAASKHKQLSELLRGGSGSSI; | (SEQ ID NO: 38) |
| mm) | CBP-2:<br>KRKLIQQQLVLLLHAHKCQRR; | (SEQ ID NO: 39) |
| nn) | P300:<br>DAASKHKQLSELLRSGSSPNL; | (SEQ ID NO: 40) |
| oo) | CIA:<br>GHPPAIQSLINLLADNRYLTA; | (SEQ ID NO: 41) |
| pp) | ARA70-1:<br>TLQQQAQQLYSLLGQFNCLTH; | (SEQ ID NO: 42) |
| qq) | ARA70-2:<br>GSRETSEKFKLLFQSYNVNDW; | (SEQ ID NO: 43) |
| rr) | TIF1:<br>NANYPRSILTSLLLNSSQSST; | (SEQ ID NO: 44) |
| ss) | NSD1:<br>IPIEPDYKFSTLLMMLKDMHD; | (SEQ ID NO: 45) |
| tt) | SMAP:<br>ATPPPSPLLSELLKKGSLLPT; | (SEQ ID NO: 46) |
| uu) | Tip60:<br>VDGHERAMLKRLLRIDSKCLH; | (SEQ ID NO: 47) |
| vv) | ERAP140:<br>HEDLDKVKLIEYYLTKNKEGP; | (SEQ ID NO: 48) |
| ww) | Nix1:<br>ESPEFCLGLQTLLSLKCCIDL; | (SEQ ID NO: 49) |
| xx) | LCoR:<br>AATTQNPVLSKLLMADQDSPL; | (SEQ ID NO: 50) |
| yy) | CoRNR1 (N-CoR):<br>MGQVPRTHRLITLADHICQIITQDFARNQV; | (SEQ ID NO: 51) |
| zz) | CoRNR2 (N-CoR):<br>NLGLEDIIRKALMG; | (SEQ ID NO: 52) |
| aaa) | CoRNR1 (SMRT):<br>APGVKGHQRVVTLAQHISEVITQDTYRHHPQQLSAPLPAP; | (SEQ ID NO: 53) |
| bbb) | CoRNR2 (SMRT):<br>NMGLEAIIRKALMG; | (SEQ ID NO: 54) |

| | -continued | |
|---|---|---|
| ccc) | RIP140-C:<br>RLTKTNPILYYMLQKGGNSVA; | (SEQ ID NO: 55) |
| ddd) | RIP140-1:<br>QDSIVLTYLEGLLMHQAAGGS; | (SEQ ID NO: 56) |
| eee) | RIP140-2:<br>KGKQDSTLLASLLQSFSSRLQ; | (SEQ ID NO: 57) |
| fff) | RIP140-3:<br>CYGVASSHLKTLLKKSKVKDQ; | (SEQ ID NO: 58) |
| ggg) | RIP140-4:<br>KPSVACSQLALLLSSEAHLQQ; | (SEQ ID NO: 59) |
| hhh) | RIP140-5:<br>KQAANNSLLLHLLKSQTIPKP; | (SEQ ID NO: 60) |
| iii) | RIP140-6:<br>NSHQKVTLLQLLLGHKNEENV; | (SEQ ID NO: 61) |
| jjj) | RIP140-7:<br>NLLERRTVLQLLLGNPTKGRV; | (SEQ ID NO: 62) |
| kkk) | RIP140-8:<br>FSFSKNGLLSRLLRQNQDSYL; | (SEQ ID NO: 63) |
| lll) | RIP140-9:<br>RESKSFNVLKQLLLSENCVRD; | (SEQ ID NO: 64) |
| mmm) | PRIC285-1:<br>ELNADDAILRELLDESQKVMV; | (SEQ ID NO: 65) |
| nnn) | PRIC285-2:<br>YENLPPAALRKLLRAEPERYR; | (SEQ ID NO: 66) |
| ooo) | PRIC285-3:<br>MAFAGDEVLVQLLSGDKAPEG; | (SEQ ID NO: 67) |
| ppp) | PRIC285-4:<br>SCCYLCIRLEGLLAPTASPRP;<br>and | (SEQ ID NO: 68) |
| qqq) | PRIC285-5:<br>PSNKSVDVLAGLLLRRMELKP. | (SEQ ID NO: 69) |

15. A heterodimeric, conditionally active receptor comprising: a) a first chimeric polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second chimeric polypeptide comprising: i) a transmembrane domain; ii) a second modulatory domain; iii) a second member of the dimerization pair; and iv) an intracellular signaling domain; or comprising: a) a first chimeric polypeptide comprising: i) a first member of a specific binding pair; ii) a modulatory domain; iii) a first member of a dimerization pair; iv) a transmembrane domain interposed between the first member of a specific binding pair and the modulatory domain; and b) a second chimeric polypeptide comprising: i) a second member of the dimerization pair; and ii) an intracellular signaling domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor, wherein the first chimeric polypeptide and the second chimeric polypeptide are dimerized in the presence of a dimerization agent that induces binding of the LBD to the co-regulator.

16. The heterodimeric, conditionally active receptor of aspect 15, wherein the first polypeptide comprises a hinge region interposed between the first member of the specific binding pair and the transmembrane domain.

17. The heterodimeric, conditionally active receptor of aspect 15, wherein the first member of the specific binding pair is an antibody or antibody fragment, a ligand, a receptor, or a non-antibody-based recognition scaffold.

18. The heterodimeric, conditionally active receptor of aspect 17, wherein the hinge region is an immunoglobulin IgG hinge region or a hinge derived from CD8.

19. The heterodimeric, conditionally active receptor of aspect 15, wherein the first and second modulatory domains are selected from 4-1BB (CD137), CD28, ICOS, BTLA, OX-40, CD27, CD30, GITR, HVEM, DAP10, DAP12, and CD28.

20. The heterodimeric, conditionally active receptor of aspect 15, wherein the intracellular signaling domain is selected from ZAP70 and CD3-zeta.

21. The heterodimeric, conditionally active receptor of aspect 15, wherein the intracellular signaling domain comprises an immunoreceptor tyrosine-based activation motif (ITAM).

22. The heterodimeric, conditionally active receptor of any one of aspects 15-21, wherein LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor.

23. The heterodimeric, conditionally active receptor of any one of aspects 15-22, wherein the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

24. The heterodimeric, conditionally active receptor of any one of aspects 15-22, wherein the co-regulator of the nuclear hormone receptor is selected from:

a) SRC1:
   CPSSHSSLTERHKILHRLLQEGSPS; (SEQ ID NO: 1)

b) SRC1-2:
   SLTARHKILHRLLQEGSPSDI; (SEQ ID NO: 2)

c) SRC3-1:
   ESKGHKKLLQLLTCSSDDR; (SEQ ID NO: 3)

d) SRC3:
   PKKENNALLRYLLDRDDPSDV; (SEQ ID NO: 4)

e) PGC-1:
   AEEPSLLKKLLLAPANT; (SEQ ID NO: 5)

f) PGC1a:
   QEAEEPSLLKKLLLAPANTQL; (SEQ ID NO: 6)

g) TRAP220-1:
   SKVSQNPILTSLLQITGNGGS; (SEQ ID NO: 7)

h) NCoR (2051-2075):
   GHSFADPASNLGLEDIIRKALMGSF; (SEQ ID NO: 8)

i) NR0B1:
   PRQGSILYSMLTSAKQT; (SEQ ID NO: 9)

j) NRIP1:
   AANNSLLLHLLKSQTIP; (SEQ ID NO: 10)

k) TIF2:
   PKKKENALLRYLLDKDDTKDI; (SEQ ID NO: 11)

l) CoRNR Box:
   DAFQLRQLILRGLQDD; (SEQ ID NO: 12)

m) αβV:
   SPGSREWFKDMLS; (SEQ ID NO: 13)

n) TRAP220-2:
   GNTKNHPMLMNLLKDNPAQDF; (SEQ ID NO: 14)

o) EA2:
   SSKGVLWRMLAEPVSR; (SEQ ID NO: 15)

p) TA1:
   SRTLQLDWGTLYWSR; (SEQ ID NO: 16)

q) EAB1:
   SSNHQSSRLIELLSR; (SEQ ID NO: 17)

r) SRC2:
   LKEKHKILHRLLQDSSSPV; (SEQ ID NO: 18)

s) SRC1-3:
   QAQQKSLLQQLLTE; (SEQ ID NO: 19)

t) SRC1-1:
   KYSQTSHKLVQLLTTTAEQQL; (SEQ ID NO: 20)

u) SRC1-2:
   SLTARHKILHRLLQEGSPSDI; (SEQ ID NO: 21)

v) SRC1-3:
   KESKDHQLLRYLLDKDEKDLR; (SEQ ID NO: 22)

w) SRC1-4a:
   PQAQQKSLLQQLLTE; (SEQ ID NO: 23)

x) SRC1-4b: (SEQ ID NO: 24)
PQAQQKSLRQQLLTE;

y) GRIP1-1: (SEQ ID NO: 25)
HDSKGQTKLLQLLTTKSDQME;

z) GRIP1-2: (SEQ ID NO: 26)
SLKEKHKILHRLLQDSSSPVD;

aa) GRIP1-3: (SEQ ID NO: 27)
PKKKENALLRYLLDKDDTKDI;

bb) AIB1-1: (SEQ ID NO: 28)
LESKGHKKLLQLLTCSSDDRG;

cc) AIB1-2: (SEQ ID NO: 29)
LLQEKHRILHKLLQNGNSPAE;

dd) AIB1-3: (SEQ ID NO: 30)
KKKENNALLRYLLDRDDPSDA;

ee) PGC1a: (SEQ ID NO: 31)
QEAEEPSLLKKLLLAPANTQL;

ff) PGC1b: (SEQ ID NO: 32)
PEVDELSLLQKLLLATSYPTS;

gg) PRC: (SEQ ID NO: 33)
VSPREGSSLHKLLTLSRTPPE;

hh) TRAP220-1: (SEQ ID NO: 34)
SKVSQNPILTSLLQITGNGGS;

ii) TRAP220-2: (SEQ ID NO: 35)
GNTKNHPMLMNLLKDNPAQDF;

jj) ASC2-1: (SEQ ID NO: 36)
DVTLTSPLLVNLLQSDISAGH;

kk) ASC2-2: (SEQ ID NO: 37)
AMREAPTSLSQLLDNSGAPNV;

ll) CBP-1: (SEQ ID NO: 38)
DAASKHKQLSELLRGGSGSSI;

mm) CBP-2: (SEQ ID NO: 39)
KRKLIQQQLVLLLHAHKCQRR;

nn) P300: (SEQ ID NO: 40)
DAASKHKQLSELLRSGSSPNL;

oo) CIA: (SEQ ID NO: 41)
GHPPAIQSLINLLADNRYLTA;

pp) ARA70-1: (SEQ ID NO: 42)
TLQQQAQQLYSLLGQFNCLTH;

qq) ARA70-2: (SEQ ID NO: 43)
GSRETSEKFKLLFQSYNVNDW;

rr) TIF1: (SEQ ID NO: 44)
NANYPRSILTSLLLNSSQSST;

ss) NSD1: (SEQ ID NO: 45)
IPIEPDYKFSTLLMMLKDMHD;

tt) SMAP: (SEQ ID NO: 46)
ATPPPSPLLSELLKKGSLLPT;

uu) Tip60: (SEQ ID NO: 47)
VDGHERAMLKRLLRIDSKCLH;

vv) ERAP140: (SEQ ID NO: 48)
HEDLDKVKLIEYYLTKNKEGP;

ww) Nix1: (SEQ ID NO: 49)
ESPEFCLGLQTLLSLKCCIDL;

xx) LCoR: (SEQ ID NO: 50)
AATTQNPVLSKLLMADQDSPL;

yy) CoRNR1 (N-CoR): (SEQ ID NO: 51)
MGQVPRTHRLITLADHICQIITQDFARNQV;

zz) CoRNR2 (N-CoR): (SEQ ID NO: 52)
NLGLEDIIRKALMG;

aaa) CoRNR1 (SMRT): (SEQ ID NO: 53)
APGVKGHQRVVTLAQHISEVITQDTYRHHPQQLSAPLPAP;

bbb) CoRNR2 (SMRT): (SEQ ID NO: 54)
NMGLEAIIRKALMG;

ccc) RIP140-C: (SEQ ID NO: 55)
RLTKTNPILYYMLQKGGNSVA;

ddd) RIP140-1: (SEQ ID NO: 56)
QDSIVLTYLEGLLMHQAAGGS;

eee) RIP140-2: (SEQ ID NO: 57)
KGKQDSTLLASLLQSFSSRLQ;

fff) RIP140-3: (SEQ ID NO: 58)
CYGVASSHLKTLLKKSKVKDQ;

ggg) RIP140-4: (SEQ ID NO: 59)
KPSVACSQLALLLSSEAHLQQ;

hhh) RIP140-5: (SEQ ID NO: 60)
KQAANNSLLLHLLKSQTIPKP;

iii) RIP140-6: (SEQ ID NO: 61)
NSHQKVTLLQLLLGHKNEENV;

jjj) RIP140-7: (SEQ ID NO: 62)
NLLERRTVLQLLLGNPTKGRV;

kkk) RIP140-8: (SEQ ID NO: 63)
FSFSKNGLLSRLLRQNQDSYL;

-continued

111) RIP140-9:
    RESKSFNVLKQLLLSENCVRD;  (SEQ ID NO: 64)

mmm) PRIC285-1:
    ELNADDAILRELLDESQKVMV;  (SEQ ID NO: 65)

nnn) PRIC285-2:
    YENLPPAALRKLLRAEPERYR;  (SEQ ID NO: 66)

ooo) PRIC285-3:
    MAFAGDEVLVQLLSGDKAPEG;  (SEQ ID NO: 67)

ppp) PRIC285-4:
    SCCYLCIRLEGLLAPTASPRP;  (SEQ ID NO: 68)
    and qqq) PRIC285-5:
    PSNKSVDVLAGLLLRRMELKP.  (SEQ ID NO: 69)

25. The heterodimeric, conditionally active receptor of aspect 18, wherein: i) the first and second modulatory domains are derived from 4-1BB; ii) the first and second members of the dimerization pair are PPARγ and SRC3; and ii) the signaling domain comprises an ITAM.

26. The heterodimeric, conditionally active receptor of aspect 15, wherein the first member of the specific binding pair is a single-chain Fv.

27. The heterodimeric, conditionally active receptor of aspect 15, wherein the first member of the specific binding pair binds an epitope present on a cell, on a solid surface, or a lipid bilayer.

28. The heterodimeric, conditionally active receptor of aspect 27, wherein the cell is a cancer cell.

29. The heterodimeric, conditionally active receptor of aspect 15, wherein the intracellular signaling domain is an intracellular inhibitory domain.

30. The heterodimeric, conditionally active receptor of aspect 29, wherein the intracellular inhibitory domain is derived from a protein selected from the group consisting of: PD-1, CTLA4, HPK1, SHP1, SHP2, Sts1, and Csk.

31. A heterodimeric, conditionally repressible synthetic immune cell receptor (ICR) comprising: a synthetic stimulatory ICR comprising a first member of a dimerization pair linked to the synthetic stimulatory ICR; and a synthetic ICR repressor comprising a second member of the dimerization pair linked to an intracellular inhibitory domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor, wherein the synthetic stimulatory ICR and the synthetic ICR repressor are dimerized in the presence of a dimerization agent that induces binding of the LBD to the co-regulator.

32. The conditionally repressible synthetic ICR of Aspect 31, wherein the synthetic stimulatory ICR comprises an intracellular co-stimulatory domain.

33. The conditionally repressible synthetic ICR of Aspect 32, wherein the intracellular co-stimulatory domain is selected from the group consisting of: 4-1BB (CD137), CD28, ICOS, OX-40, BTLA, CD27, CD30, GITR, and HVEM.

34. The conditionally repressible synthetic ICR of any one of aspects 31-33, wherein the first member of a dimerization pair is linked intracellularly to the synthetic stimulatory ICR and the second member of the dimerization pair is linked intracellularly to the intracellular inhibitory domain.

35. The conditionally repressible synthetic ICR of any one of aspects 31-34, wherein the synthetic ICR repressor further comprises a transmembrane domain.

36. The conditionally repressible synthetic ICR of Aspect 35, wherein the second member of the dimerization pair is linked intracellularly to the transmembrane domain.

37. The conditionally repressible synthetic ICR of Aspect 35, wherein the second member of the dimerization pair is extracellular and linked to the intracellular inhibitory domain by way of the transmembrane domain.

38. The conditionally repressible synthetic ICR of any one of aspects 31-37, wherein the stimulatory ICR binds a soluble antigen.

39. The conditionally repressible synthetic ICR of any one of aspects 31-38, wherein the stimulatory ICR binds a cell surface antigen.

40. The conditionally repressible synthetic ICR of any one aspects 31-39, wherein the intracellular inhibitory domain is an inhibitory domain derived from a protein selected from the group consisting of: PD-1, CTLA4, HPK1, SHP1, SHP2, Sts1 and Csk.

41. The conditionally repressible synthetic ICR of any one of aspects 31-40, wherein the synthetic stimulatory ICR comprises an intracellular signaling domain selected from the group consisting of: a CD3-zeta signaling domain, a ZAP70 signaling domain and an immunoreceptor tyrosine-based activation motif (ITAM).

42. The conditionally repressible synthetic ICR of any one of aspects 31-41, wherein LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor.

43. The conditionally repressible synthetic ICR of any one of aspects 41-42, wherein the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

44. The conditionally repressible synthetic ICR of any one of aspects 41-42, wherein the co-regulator of the nuclear hormone receptor is selected from:

a) SRC1:
    CPSSHSSLTERHKILHRLLQEGSPS;  (SEQ ID NO: 1)

b) SRC1-2:
    SLTARHKILHRLLQEGSPSDI;  (SEQ ID NO: 2)

c) SRC3-1:
    ESKGHKKLLQLLTCSSDDR;  (SEQ ID NO: 3)

d) SRC3:
    PKKENNALLRYLLDRDDPSDV;  (SEQ ID NO: 4)

-continued e) PGC-1:
(SEQ ID NO: 5)
AEEPSLLKKLLLAPANT;

f) PGC1a:
(SEQ ID NO: 6)
QEAEEPSLLKKLLLAPANTQL;

g) TRAP220-1:
(SEQ ID NO: 7)
SKVSQNPILTSLLQITGNGGS;

h) NCoR (2051-2075):
(SEQ ID NO: 8)
GHSFADPASNLGLEDIIRKALMGSF;

i) NR0B1:
(SEQ ID NO: 9)
PRQGSILYSMLTSAKQT;

j) NRIP1:
(SEQ ID NO: 10)
AANNSLLLHLLKSQTIP;

k) TIF2:
(SEQ ID NO: 11)
PKKKENALLRYLLDKDDTKDI;

l) CoRNR Box:
(SEQ ID NO: 12)
DAFQLRQLILRGLQDD;

m) αβV:
(SEQ ID NO: 13)
SPGSREWFKDMLS;

n) TRAP220-2:
(SEQ ID NO: 14)
GNTKNHPMLMNLLKDNPAQDF;

o) EA2:
(SEQ ID NO: 15)
SSKGVLWRMLAEPVSR;

p) TA1:
(SEQ ID NO: 16)
SRTLQLDWGTLYWSR;

q) EAB1:
(SEQ ID NO: 17)
SSNHQSSRLIELLSR;

r) SRC2:
(SEQ ID NO: 18)
LKEKHKILHRLLQDSSSPV;

s) SRC1-3:
(SEQ ID NO: 19)
QAQQKSLLQQLLTE;

t) SRC1-1:
(SEQ ID NO: 20)
KYSQTSHKLVQLLTTTAEQQL;

u) SRC1-2:
(SEQ ID NO: 21)
SLTARHKILHRLLQEGSPSDI;

v) SRC1-3:
(SEQ ID NO: 22)
KESKDHQLLRYLLDKDEKDLR;

w) SRC1-4a:
(SEQ ID NO: 23)
PQAQQKSLLQQLLTE;

x) SRC1-4b:
(SEQ ID NO: 24)
PQAQQKSLRQQLLTE;

y) GRIP1-1:
(SEQ ID NO: 25)
HDSKGQTKLLQLLTTKSDQME;

z) GRIP1-2:
(SEQ ID NO: 26)
SLKEKHKILHRLLQDSSSPVD;

aa) GRIP1-3:
(SEQ ID NO: 27)
PKKKENALLRYLLDKDDTKDI;

bb) AIB1-1:
(SEQ ID NO: 28)
LESKGHKKLLQLLTCSSDDRG;

cc) AIB1-2:
(SEQ ID NO: 29)
LLQEKHRILHKLLQNGNSPAE;

dd) AIB1-3:
(SEQ ID NO: 30)
KKKENNALLRYLLDRDDPSDA;

ee) PGC1a:
(SEQ ID NO: 31)
QEAEEPSLLKKLLLAPANTQL;

ff) PGC1b:
(SEQ ID NO: 32)
PEVDELSLLQKLLLATSYPTS;

gg) PRC:
(SEQ ID NO: 33)
VSPREGSSLHKLLTLSRTPPE;

hh) TRAP220-1:
(SEQ ID NO: 34)
SKVSQNPILTSLLQITGNGGS;

ii) TRAP220-2:
(SEQ ID NO: 35)
GNTKNHPMLMNLLKDNPAQDF;

jj) ASC2-1:
(SEQ ID NO: 36)
DVTLTSPLLVNLLQSDISAGH;

kk) ASC2-2:
(SEQ ID NO: 37)
AMREAPTSLSQLLDNSGAPNV;

ll) CBP-1:
(SEQ ID NO: 38)
DAASKHKQLSELLRGGSGSSI;

mm) CBP-2:
(SEQ ID NO: 39)
KRKLIQQQLVLLLHAHKCQRR;

nn) P300:
(SEQ ID NO: 40)
DAASKHKQLSELLRSGSSPNL;

oo) CIA:
(SEQ ID NO: 41)
GHPPAIQSLINLLADNRYLTA;

pp) ARA70-1:
(SEQ ID NO: 42)
TLQQQAQQLYSLLGQFNCLTH;

qq) ARA70-2:
(SEQ ID NO: 43)
GSRETSEKFKLLFQSYNVNDW;

rr) TIF1:
(SEQ ID NO: 44)
NANYPRSILTSLLLNSSQSST;

| | | |
|---|---|---|
| ss) | NSD1: IPIEPDYKFSTLLMMLKDMHD; | (SEQ ID NO: 45) |
| tt) | SMAP: ATPPPSPLLSELLKKGSLLPT; | (SEQ ID NO: 46) |
| uu) | Tip60: VDGHERAMLKRLLRIDSKCLH; | (SEQ ID NO: 47) |
| vv) | ERAP140: HEDLDKVKLIEYYLTKNKEGP; | (SEQ ID NO: 48) |
| ww) | Nix1: ESPEFCLGLQTLLSLKCCIDL; | (SEQ ID NO: 49) |
| xx) | LCoR: AATTQNPVLSKLLMADQDSPL; | (SEQ ID NO: 50) |
| yy) | CoRNR1 (N-CoR): MGQVPRTHRLITLADHICQIITQDFARNQV; | (SEQ ID NO: 51) |
| zz) | CoRNR2 (N-CoR): NLGLEDIIRKALMG; | (SEQ ID NO: 52) |
| aaa) | CoRNR1 (SMRT): APGVKGHQRVVTLAQHISEVITQDTYRHHPQQLSAPLPAP; | (SEQ ID NO: 53) |
| bbb) | CoRNR2 (SMRT): NMGLEAIIRKALMG; | (SEQ ID NO: 54) |
| ccc) | RIP140-C: RLTKTNPILYYMLQKGGNSVA; | (SEQ ID NO: 55) |
| ddd) | RIP140-1: QDSIVLTYLEGLLMHQAAGGS; | (SEQ ID NO: 56) |
| eee) | RIP140-2: KGKQDSTLLASLLQSFSSRLQ; | (SEQ ID NO: 57) |
| fff) | RIP140-3: CYGVASSHLKTLLKKSKVKDQ; | (SEQ ID NO: 58) |
| ggg) | RIP140-4: KPSVACSQLALLLSSEAHLQQ; | (SEQ ID NO: 59) |
| hhh) | RIP140-5: KQAANNSLLLHLLKSQTIPKP; | (SEQ ID NO: 60) |
| iii) | RIP140-6: NSHQKVTLLQLLLGHKNEENV; | (SEQ ID NO: 61) |
| jjj) | RIP140-7: NLLERRTVLQLLLGNPTKGRV; | (SEQ ID NO: 62) |
| kkk) | RIP140-8: FSFSKNGLLSRLLRQNQDSYL; | (SEQ ID NO: 63) |
| lll) | RIP140-9: RESKSFNVLKQLLLSENCVRD; | (SEQ ID NO: 64) |
| mmm) | PRIC285-1: ELNADDAILRELLDESQKVMV; | (SEQ ID NO: 65) |
| nnn) | PRIC285-2: YENLPPAALRKLLRAEPERYR; | (SEQ ID NO: 66) |
| ooo) | PRIC285-3: MAFAGDEVLVQLLSGDKAPEG; | (SEQ ID NO: 67) |
| ppp) | PRIC285-4: SCCYLCIRLEGLLAPTASPRP; and | (SEQ ID NO: 68) |
| qqq) | PRIC285-5: PSNKSVDVLAGLLLRRMELKP. | (SEQ ID NO: 69) |

45. The conditionally repressible synthetic ICR of any one of aspects 31-44, wherein the synthetic stimulatory ICR is a synthetic chimeric antigen receptor (CAR) or portion thereof.

46. The conditionally repressible synthetic ICR of any one of aspects 31-45, wherein the synthetic stimulatory ICR is a synthetic T cell receptor (TCR) or portion thereof.

47. A heterodimeric, conditionally repressible synthetic chimeric antigen receptor (CAR) comprising: a) a synthetic stimulatory CAR comprising: i) a extracellular recognition domain; ii) a transmembrane domain linked to the extracellular recognition domain; iii) a first member of a dimerization pair linked to the transmembrane domain; and iv) an intracellular stimulation domain; and b) a synthetic CAR repressor comprising: i) a second member of the dimerization pair; and ii) an intracellular inhibitory domain linked to the second member of the dimerization pair, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the synthetic stimulatory CAR and the synthetic CAR repressor are dimerized in the presence of a dimerization agent that induces binding of the LBD to the co-regulator.

48. The heterodimeric, conditionally repressible synthetic CAR of Aspect 47, wherein the synthetic CAR repressor further comprises a transmembrane domain linked to the second member of the dimerization pair, the intracellular inhibitory domain or both.

49. A heterodimeric, conditionally repressible synthetic T cell receptor (TCR) comprising: a) a synthetic stimulatory TCR comprising: i) a transmembrane domain; ii) a first member of a dimerization pair linked to the transmembrane domain; iii) an engineered TCR polypeptide comprising at least one TCR alpha or beta chain, wherein the at least one TCR alpha or beta chain is linked to the transmembrane domain or the first member of a dimerization pair; and b) a synthetic TCR repressor comprising: i) a second member of the dimerization pair; and ii) an intracellular inhibitory domain linked to the second member of the dimerization pair, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the synthetic stimulatory TCR and the synthetic TCR repressor are dimerized in the presence of a dimerization agent that induces binding of the LBD to the co-regulator.

50. The heterodimeric, conditionally repressible synthetic TCR of Aspect 49, wherein the synthetic TCR repressor further comprises a transmembrane domain linked to the second member of the dimerization pair, the intracellular inhibitory domain or both.

51. The heterodimeric, conditionally repressible synthetic TCR of Aspects 49 or 50, wherein the engineered TCR polypeptide further comprises a TCR gamma chain.

52. A heterodimeric, conditionally active chimeric antigen receptor (CAR) comprising: a) a first polypeptide comprising: i) a first member of a specific binding pair; ii) a first modulatory domain; iii) a first member of a dimerization pair; and iv) a transmembrane domain interposed between the first member of a specific binding pair and the first modulatory domain; and b) a second polypeptide comprising: i) a transmembrane domain; ii) a second modulatory domain; iii) a second member of the dimerization pair; and iv) an intracellular signaling domain; or comprising: a) a first polypeptide comprising: i) a first member of a specific binding pair; ii) a modulatory domain; iii) a first member of a dimerization pair; iv) a transmembrane domain interposed between the first member of a specific binding pair and the modulatory domain; and b) a second polypeptide comprising: i) a second member of the dimerization pair; and ii) an intracellular signaling domain, wherein the first member of the dimerization pair comprises a ligand-binding domain (LBD) of a nuclear hormone receptor, and the second member of the dimerization pair comprises a co-regulator of the nuclear hormone receptor, or wherein the first member of the dimerization pair is a co-regulator of a nuclear hormone receptor, and the second member of the dimerization pair comprises an LBD of the nuclear hormone receptor; and wherein the first polypeptide and the second polypeptide are dimerized in the presence of a dimerization agent that induces binding of the LBD to the co-regulator.

53. The heterodimeric, conditionally active CAR of aspect 52, wherein the first polypeptide comprises a hinge region interposed between the first member of the specific binding pair and the transmembrane domain.

54. The heterodimeric, conditionally active CAR of aspect 52, wherein the first member of the specific binding pair is an antibody or antibody fragment, a ligand, or a receptor.

55. The heterodimeric, conditionally active CAR of aspect 53, wherein the hinge region is an immunoglobulin IgG hinge region or a hinge derived from CD8.

56. The heterodimeric, conditionally active CAR of aspect 52, wherein the first and second modulatory domains are selected from 4-1BB (CD137), CD28, ICOS, BTLA, OX-40, CD27, CD30, GITR, HVEM, DAP10, DAP12, and CD28.

57. The heterodimeric, conditionally active CAR of aspect 52, wherein the intracellular signaling domain is selected from ZAP70 and CD3-zeta.

58. The heterodimeric, conditionally active CAR of aspect 52, wherein the intracellular signaling domain comprises an immunoreceptor tyrosine-based activation motif (ITAM).

59. The heterodimeric, conditionally active CAR of any one of aspects 52-58, wherein LBD of the nuclear hormone binding member of the dimerization pair is an LBD of a nuclear hormone receptor selected from estrogen receptor, an ecdysone receptor, a PPARγ receptor, a glucocorticoid receptor, an androgen receptor, a thyroid hormone receptor, a mineralocorticoid receptor, a progesterone receptor, a vitamin D receptor, a PPARβ receptor, a PPARα receptor, a pregnane X receptor, a liver X receptor, a farnesoid X receptor, a retinoid X receptor, a RAR-related orphan receptor, and a retinoic acid receptor.

60. The heterodimeric, conditionally active CAR of any one of aspects 52-59, wherein the co-regulator of the nuclear hormone receptor is selected from SRC1, GRIP1, AIB1, PGC1a, PGC1b, PRC, TRAP220, ASC2, CBP, P300, CIA, ARA70, TIF1, NSD1, SMAP, Tip60, ERAP140, Nix1, LCoR, N-CoR, SMRT, RIP140, and PRIC285.

61. The heterodimeric, conditionally active CAR of any one of aspects 52-59, wherein the co-regulator of the nuclear hormone receptor is selected from:

```
a) SRC1:
                                        (SEQ ID NO: 1)
CPSSHSSLTERHKILHRLLQEGSPS;

b) SRC1-2:
                                        (SEQ ID NO: 2)
SLTARHKILHRLLQEGSPSDI;

c) SRC3-1:
                                        (SEQ ID NO: 3)
ESKGHKKLLQLLTCSSDDR;

d) SRC3:
                                        (SEQ ID NO: 4)
PKKENNALLRYLLDRDDPSDV;

e) PGC-1:
                                        (SEQ ID NO: 5)
AEEPSLLKKLLLAPANT;

f) PGC1a:
                                        (SEQ ID NO: 6)
QEAEEPSLLKKLLLAPANTQL;

g) TRAP220-1:
                                        (SEQ ID NO: 7)
SKVSQNPILTSLLQITGNGGS;

h) NCoR (2051-2075):
                                        (SEQ ID NO: 8)
GHSFADPASNLGLEDIIRKALMGSF;

i) NR0B1:
                                        (SEQ ID NO: 9)
PRQGSILYSMLTSAKQT;

j) NRIP1:
                                        (SEQ ID NO: 10)
AANNSLLLHLLKSQTIP;

k) TIF2:
                                        (SEQ ID NO: 11)
PKKKENALLRYLLDKDDTKDI;

l) CoRNR Box:
                                        (SEQ ID NO: 12)
DAFQLRQLILRGLQDD;

m) αβV:
                                        (SEQ ID NO: 13)
SPGSREWFKDMLS;

n) TRAP220-2:
                                        (SEQ ID NO: 14)
GNTKNHPMLMNLLKDNPAQDF;
```

-continued o) EA2:
SSKGVLWRMLAEPVSR; (SEQ ID NO: 15)

p) TA1:
SRTLQLDWGTLYWSR; (SEQ ID NO: 16)

q) EAB1:
SSNHQSSRLIELLSR; (SEQ ID NO: 17)

r) SRC2:
LKEKHKILHRLLQDSSSPV; (SEQ ID NO: 18)

s) SRC1-3:
QAQQKSLLQQLLTE; (SEQ ID NO: 19)

t) SRC1-1:
KYSQTSHKLVQLLTTTAEQQL; (SEQ ID NO: 20)

u) SRC1-2:
SLTARHKILHRLLQEGSPSDI; (SEQ ID NO: 21)

v) SRC1-3:
KESKDHQLLRYLLDKDEKDLR; (SEQ ID NO: 22)

w) SRC1-4a:
PQAQQKSLLQQLLTE;; (SEQ ID NO: 23)

x) SRC1-4b:
PQAQQKSLRQQLLTE; (SEQ ID NO: 24)

y) GRIP1-1:
HDSKGQTKLLQLLTTKSDQME; (SEQ ID NO: 25)

z) GRIP1-2:
SLKEKHKILHRLLQDSSSPVD; (SEQ ID NO: 26)

aa) GRIP1-3:
PKKKENALLRYLLDKDDTKDI; (SEQ ID NO: 27)

bb) AIB1-1:
LESKGHKKLLQLLTCSSDDRG; (SEQ ID NO: 28)

cc) AIB1-2:
LLQEKHRILHKLLQNGNSPAE; (SEQ ID NO: 29)

dd) AIB1-3:
KKKENNALLRYLLDRDDPSDA; (SEQ ID NO: 30)

ee) PGC1a:
QEAEEPSLLKKLLLAPANTQL; (SEQ ID NO: 31)

ff) PGC1b:
PEVDELSLLQKLLLATSYPTS; (SEQ ID NO: 32)

gg) PRC:
VSPREGSSLHKLLTLSRTPPE; (SEQ ID NO: 33)

hh) TRAP220-1:
SKVSQNPILTSLLQITGNGGS; (SEQ ID NO: 34)

ii) TRAP220-2:
GNTKNHPMLMNLLKDNPAQDF; (SEQ ID NO: 35)

jj) ASC2-1:
DVTLTSPLLVNLLQSDISAGH; (SEQ ID NO: 36)

kk) ASC2-2:
AMREAPTSLSQLLDNSGAPNV; (SEQ ID NO: 37)

ll) CBP-1:
DAASKHKQLSELLRGGSGSSI; (SEQ ID NO: 38)

mm) CBP-2:
KRKLIQQQLVLLLHAHKCQRR; (SEQ ID NO: 39)

nn) P300:
DAASKHKQLSELLRSGSSPNL; (SEQ ID NO: 40)

oo) CIA:
GHPPAIQSLINLLADNRYLTA; (SEQ ID NO: 41)

pp) ARA70-1:
TLQQQAQQLYSLLGQFNCLTH; (SEQ ID NO: 42)

qq) ARA70-2:
GSRETSEKFKLLFQSYNVNDW; (SEQ ID NO: 43)

rr) TIF1:
NANYPRSILTSLLLNSSQSST; (SEQ ID NO: 44)

ss) NSD1:
IPIEPDYKFSTLLMMLKDMHD; (SEQ ID NO: 45)

tt) SMAP:
ATPPPSPLLSELLKKGSLLPT; (SEQ ID NO: 46)

uu) Tip60:
VDGHERAMLKRLLRIDSKCLH; (SEQ ID NO: 47)

vv) ERAP140:
HEDLDKVKLIEYYLTKNKEGP; (SEQ ID NO: 48)

ww) Nix1:
ESPEFCLGLQTLLSLKCCIDL; (SEQ ID NO: 49)

xx) LCoR:
AATTQNPVLSKLLMADQDSPL; (SEQ ID NO: 50)

yy) CoRNR1 (N-CoR):
MGQVPRTHRLITLADHICQIITQDFARNQV; (SEQ ID NO: 51)

zz) CoRNR2 (N-CoR):
NLGLEDIIRKALMG; (SEQ ID NO: 52)

aaa) CoRNR1 (SMRT):
APGVKGHQRVVTLAQHISEVITQDTYRHHPQQLSAPLPAP; (SEQ ID NO: 53)

bbb) CoRNR2 (SMRT):
NMGLEAIIRKALMG; (SEQ ID NO: 54)

```
ccc) RIP140-C:
                                       (SEQ ID NO: 55)
RLTKTNPILYYMLQKGGNSVA;

ddd) RIP140-1:
                                       (SEQ ID NO: 56)
QDSIVLTYLEGLLMHQAAGGS;

eee) RIP140-2:
                                       (SEQ ID NO: 57)
KGKQDSTLLASLLQSFSSRLQ;

fff) RIP140-3:
                                       (SEQ ID NO: 58)
CYGVASSHLKTLLKKSKVKDQ;

ggg) RIP140-4:
                                       (SEQ ID NO: 59)
KPSVACSQLALLLSSEAHLQQ;

hhh) RIP140-5:
                                       (SEQ ID NO: 60)
KQAANNSLLLHLLKSQTIPKP;

iii) RIP140-6:
                                       (SEQ ID NO: 61)
NSHQKVTLLQLLLGHKNEENV;

jjj) RIP140-7:
                                       (SEQ ID NO: 62)
NLLERRTVLQLLLGNPTKGRV;

kkk) RIP140-8:
                                       (SEQ ID NO: 63)
FSFSKNGLLSRLLRQNQDSYL;

lll) RIP140-9:
                                       (SEQ ID NO: 64)
RESKSFNVLKQLLLSENCVRD;

mmm) PRIC285-1:
                                       (SEQ ID NO: 65)
ELNADDAILRELLDESQKVMV;

nnn) PRIC285-2:
                                       (SEQ ID NO: 66)
YENLPPAALRKLLRAEPERYR;

ooo) PRIC285-3:
                                       (SEQ ID NO: 67)
MAFAGDEVLVQLLSGDKAPEG;

ppp) PRIC285-4:
                                       (SEQ ID NO: 68)
SCCYLCIRLEGLLAPTASPRP;
and qqq) PRIC285-5:
                                       (SEQ ID NO: 69)
PSNKSVDVLAGLLLRRMELKP.
```

63. The heterodimeric, conditionally active CAR of any one of aspects 52-62, wherein the first member of the specific binding pair is a single-chain Fv.

64. The heterodimeric, conditionally active CAR of any one of aspects 52-63, wherein the first member of the specific binding pair binds an epitope present on a cell, on a solid surface, or a lipid bilayer.

65. The heterodimeric, conditionally active CAR of aspect 64, wherein the cell is a cancer cell.

66. A mammalian cell genetically modified to produce the heterodimeric, conditionally active polypeptide or receptor of any one of aspects 1-65.

67. The cell of aspect 66, wherein the cell is a stem cell, a progenitor cell, or a cell derived from a stem cell or a progenitor cell.

68. The cell of aspect 66, wherein the cell is a T lymphocyte or an NK cell.

69. A nucleic acid comprising nucleotide sequences encoding the heterodimeric, conditionally active receptor or polypeptide of any one of aspects 1-65.

70. The nucleic acid of aspect 69, wherein the nucleotide sequences are operably linked to a promoter.

71. The nucleic acid of aspect 69, wherein the promoter is an inducible promoter.

72. The nucleic acid of aspect 69, wherein the promoter is a cell type-specific or tissue-specific promoter.

73. The nucleic acid of aspect 72, wherein the promoter is a T lymphocyte-specific promoter or an NK cell-specific promoter.

74. The nucleic acid of any one of aspects 69-73, wherein the nucleic acid is in vitro transcribed RNA.

75. A recombinant expression vector comprising the nucleic acid of any one of aspects 69-74.

76. A method of modulating an activity of a eukaryotic cell, the method comprising: a) expressing the heterodimeric, conditionally active polypeptide or receptor of any one of aspects 1-65 in the eukaryotic cell; and b) contacting the cell with the ligand.

77. A method of modulating an activity of a T lymphocyte, the method comprising contacting the T lymphocyte with a dimerizing agent and a second member of a specific binding pair, wherein the T lymphocyte is genetically modified to produce a heterodimeric, conditionally active receptor of any one of aspects 15-65, and wherein, in the presence of the dimerizing agent and the second member of a specific binding pair, the heterodimeric, conditionally active receptor dimerizes and modulates an activity of the T lymphocyte, thereby producing a modulated T lymphocyte.

78. The method of aspect 77, wherein the second member of a specific binding pair is an antigen.

79. The method of aspect 77, wherein said contacting occurs in vivo.

80. The method of aspect 77, wherein the T lymphocyte is activated, thereby producing an activated T lymphocyte.

81. The method of aspect 80, wherein the activated T lymphocyte mediates killing of a target cell.

82. The method of aspect 80, wherein the activated T lymphocyte produces IL-2 and/or IFN-γ.

83. The method of aspect 81, wherein the target cell is a cancer cell.

84. A method of making the cell of any one of aspects 66-68, the method comprising genetically modifying a mammalian cell with an expression vector comprising nucleotide sequences encoding the heterodimeric, conditionally active receptor or polypeptide of any one of aspects 1-65, or genetically modifying a mammalian cell with an RNA comprising nucleotide sequences encoding the heterodimeric, conditionally active receptor or polypeptide of any one of aspects 1-65.

85. The method of aspect 84, wherein said genetic modification is carried out ex vivo.

86. The method of aspect 84 wherein the cell is a T lymphocyte, a stem cell, an NK cell, a progenitor cell, a cell derived from a stem cell, or a cell derived from a progenitor cell.

87. A method of treating a cancer in an individual, the method comprising: i) genetically modifying T lymphocytes obtained from the individual with an expression vector comprising nucleotide sequences encoding the heterodimeric, conditionally active chimeric antigen receptor (CAR) of any one of aspects 49-65, wherein the antigen-binding domain of the heterodimeric, conditionally active CAR is specific for an epitope on a cancer cell in the individual, and wherein said genetic modification is carried out ex vivo; ii)

introducing the genetically modified T lymphocytes into the individual; and iii) administering to the individual an effective amount of a dimerizing agent, wherein the dimerizing agent induces dimerization of the heterodimeric, conditionally active receptor, wherein said dimerization provides for activation of the genetically modified T lymphocytes and killing of the cancer cell, thereby treating the cancer.

88. The method of aspect 87, wherein the dimerizing agent is a nuclear hormone that binds the LBD of the nuclear hormone receptor and the co-regulator.

89. A method of modulating the activity of a host cell, the method comprising contacting the host cell with a dimerizing agent and a second member of a specific binding pair, wherein the T lymphocyte is genetically modified to produce a heterodimeric, conditionally active receptor of any one of aspects 49-65, and wherein, in the presence of the dimerizing agent and the second member of a specific binding pair, the heterodimeric, conditionally active receptor dimerizes and modulates at least one activity of the host cell.

90. The method of aspect 89, wherein the activity is proliferation, cell survival, apoptosis, gene expression, or immune activation.

91. The method of aspect 89, wherein the second member of a specific binding pair is an antigen.

Examples

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Materials and Methods

The following Materials and Methods were used for the experiments described in Examples 1 and 2.

Construction of PPARγ-Based ON-Switch CARs

The sequence encoding the anti-human CD19 scFv was cloned into expression vectors. The human 4-1BB co-stimulation and CD3 zeta ITAM signaling chains were cloned from cDNAs supplied by Open Biosystems. PPAR-gamma LBD and SRC3 co-activator peptide encoding sequences were custom synthesized by IDT DNA. Standard molecular cloning techniques (polymerase chain reaction (PCR), restriction digestion, ligation, homology-based DNA recombination etc.) were applied to generate lentiviral expression plasmids for each ON-switch CAR molecule.

Effector and Target Cell Culturing Conditions

A Jurkat cell line expressing Green Fluorescent Protein upon NFAT activation was used. The cell line was maintained in RPMI-1640 medium supplemented with 10% FBS, penicillin and streptomycin. K562 target cells (CD19+/−) from U. Penn were cultured in IMDM supplemented with 10% FBS.

Effector Cell Engineering with Lentivirus

Pantropic VSV-G pseudotyped lentivirus was produced from *Lenti*-X 293T cells (Clontech Laboratories #632180) co-transfected with a pHR' SIN:CSW transgene expression vector, viral packaging plasmids pCMVdR8.91 and pMD2.G using Lipofectamine LTX (Life Technologies #15338). Infection medium supernatant was collected 48 hours after transfection and used directly for transduction.

Jurkat cells were split 1~2 days prior to transduction to ensure that the cell culture would be in log phase at the time of transduction. Transduced cells were cultured for at least 7 days and sorted for abundant CAR expression as needed before experiments were conducted. Expression levels of ON-switch CAR molecules were quantified by flow cytometry. Part 1 of the ON-switch CAR (featuring the scFv) was stained with a fluorophore-conjugated anti-myc antibody, which recognized a myc epitope upstream of the anti-CD19 scFv. Part 2 of the ON-switch CAR (featuring the CD3zeta ITAMs) was quantified using fluorescence of mCherry, which was downstream of the ITAMs.

Quantitation of IL-2 Production by ON-Switch Jurkat Cells

Jurkat T cells expressing ON-switch CARs were co-cultured with CD19+/−K562 target cells at a 1:2 effector:target ratio. Rosiglitazone (Sigma-Aldrich #R2408) was dissolved in DMSO and added to samples to a final concentration of 10 μM. Sample without dimerizer contained the respective vehicle control (1:3000 dilution of dimethyl sulfoxide (DMSO) or 1:1000 dilution of ethanol). After 18 hours of incubation, medium supernatants were collected and analyzed with BD OptEIA Human IL-2 ELISA Set (BD Biosciences #555190).

Construction of Hormone Receptor-Based ON-Switch CARs

The sequence encoding the anti-human CD19 scFv was cloned. The human 4-1BB co-stimulation and CD3 zeta ITAM signaling chains were cloned from cDNAs supplied by Open Biosystems. Estrogen receptor LBD and co-activator peptide encoding sequences were custom synthetized by IDT DNA. The sequences of the coactivator peptides were obtained from Heldring et al J Biol Chem. 2007 Apr. 6; 282(14):10449-55, PMID 17283072. Standard molecular cloning techniques (PCR, restriction digestion, ligation, homology-based DNA recombination etc.) were applied to generate *lenti*-viral expression plasmids for each ON-switch CAR molecule.

Quantitation of CD-69 Expression by ON-Switch Jurkat Cells

A Jurkat cell line expressing Green Fluorescent Protein upon NFAT activation was used. The cell line was maintained in RPMI-1640 medium supplemented with 10% FBS and glutamine. K562 target cells (CD19+/−) were cultured in DMEM supplemented with 10% FBS. Jurkat cells infected with lentivirus with the CAR constructs were co-cultured with K562 target cells that expressed the target antigen (CD19) or an irrelevant antigen (mesothelin). 4-Hydroxytamoxifen (Sigma-Aldrich #H7904) was dissolved in DMSO and added to samples to a final concentration of 0-10 μM. The Rapalog A/C Heterodimerizer (Clontech Laboratories #635055) was dissolved in ethanol and added to a final concentration of 500 nM. The cells were cultured for 24 hours, stained for CD69 expression, and analyzed on a flow cytomter.

Effector Cell Engineering with Lentivirus

Pantropic VSV-G pseudotyped lentivirus was produced from *Lenti*-X 293T cells (Clontech Laboratories #632180) co-transfected with a pHR' SIN:CSW transgene expression vector, viral packaging plasmids pCMVdR8.91 and pMD2.G using Lipofectamine LTX (Life Technologies

15338). Infection medium supernatant was collected 48 hours after transfection and used directly for transduction.

Jurkat cells were split 1~2 days prior to transduction to ensure that the cell culture would be in log phase at the time of transduction. Transduced cells were cultured for at least 7 days and sorted for abundant CAR expression as needed before experiments were conducted. Expression levels of ON-switch CAR molecules were quantified by flow cytometry. Part 1 of the ON-switch CAR (featuring the scFv) was stained with a fluorophore-conjugated anti-myc antibody, which recognized a myc epitope upstream of the anti-CD19 scFv. Part 2 of the ON-switch CAR (featuring the CD3zeta ITAMs) was quantified using fluorescence of mCherry, which was downstream of the ITAMs.

Example 1: PPARr-Based on-Switch Car Constructs

Figure 12:
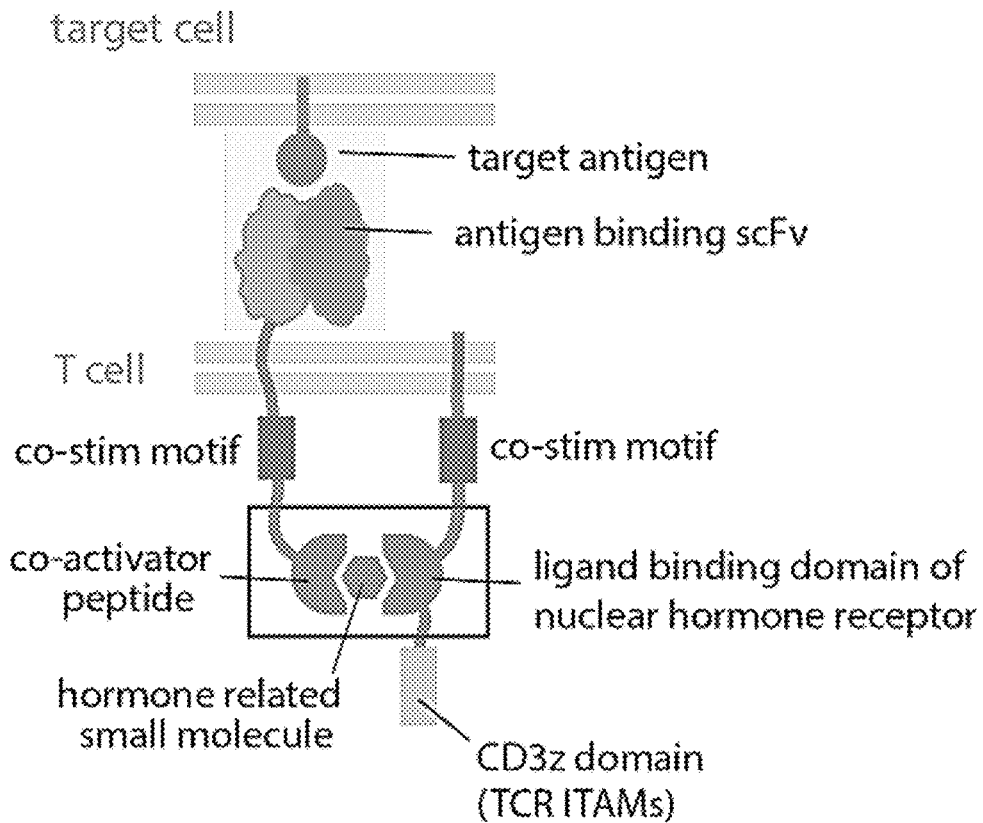
FIG. 12 is a schematic diagram of an ON-switch CAR featuring the Ligand Binding Domain (LBD) of a Nuclear Hormone Receptor, a co-regulator peptide, and a small molecule as the ternary hetero-dimerizing module.
Figure 13:
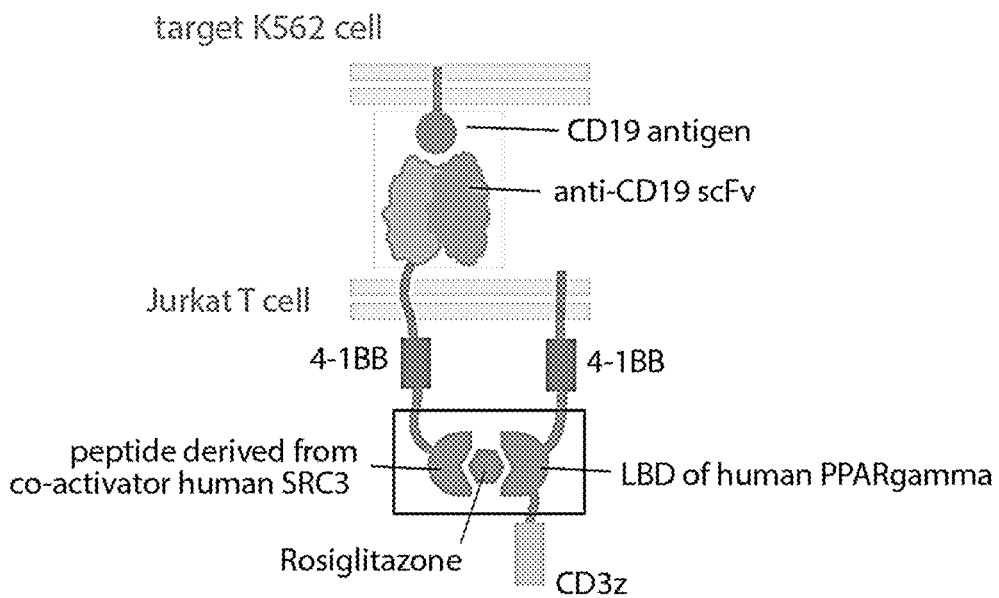
FIG. 13 is a schematic diagram of a PPARγ-based ON-switch CAR construct.

PPARγ-based ON-switch CAR constructs were generated. FIG. 12 presents a schematic diagram of the overall structure of a generalized nuclear hormone ligand binding domain (LBD)/co-activator peptide ON-switch CAR. FIG. 13 presents a schematic diagram of the overall structure of the constructs. Constructs are listed in Table 3. ON-switch constructs (bCW197, bCW206, bCW207), with FKBP and FRB* domains, were used as positive and negative control CARs.

TABLE 3

| construct ID # | encoded CAR molecule |
| --- | --- |
| bCW492 | Part 1 (antigen binding) with SRC3 co-regulator peptide, short version |
| bCW493 | Part 1 with SRC3 co-regulator peptide, short version, 3 tandem copies |
| bCW494 | Part 1 with SRC3 co-regulator peptide, long version |
| bCW495 | Part 2 with PPARgamma LBD |

Amino acid sequences of the ligand-binding domain (LBD) of PPARγ included in the CAR constructs, and amino acid sequences of the co-regulator peptides used, are set forth below.

The amino acid sequence of the LBD of PPARγ included in the CAR construct bCW495 is as follows:

(SEQ ID NO: 695)
ESADLRALAKHLYDSYIKSFPLTKAKARAILTGKTTDKSPFVIYDMNSL

MMGEDKIKFKHITPLQEQSKEVAIRIFQGCQFRSVEAVQEITEYAKSIP

GFVNLDLNDQVTLLKYGVHEIIYTMLASLMNKDGVLISEGQGFMTREFL

KSLRKPFGDFMEPKFEFAVKFNALELDDSDLAIFIAVIILSGDRPGLLN

VKPIEDIQDNLLQALELQLKLNHPESSQLFAKLLQKMTDLRQIVTEHVQ

LLQVIKKTETDMSLHPLLQEIYKDLY.

The amino acid sequence of human SRC3 co-regulator peptide, short version (P729~A750) in construct bCW492 is as follows: PKKENNALLRYLLDRDDPSDA (SEQ ID NO:696).

Construct bCW493 contained three tandem copies, with a linker/spacer between the copies, of the shorter version (P729-A750) of human SRC3 co-regulator peptide, such that the amino acid sequence of the co-regulator peptide, with linkers/spacers, in bCW493 is as follows:

(SEQ ID NO: 697)
PKKENNALLRYLLDRDDPSDAGGGSGGGSPKKENNALLRYLLDRDDPSD

AGGGSGGGSPKKENNALLRYLLDRDDPSDA, where the linker/spacer amino acid are underlined.

Construct bCW494 contained the long version (M673-A750) of human SRC3 co-regulator peptide; the amino acid sequence of the human SRC3 in bCW494 is:

(SEQ ID NO: 698)
MHGSLLQEKHRILHKLLQNGNSPAEVAKITAEATGKDTSSITSCGDGNV

VKQEQLSPKKKENNALLRYLLDRDDPSDA.

The amino acid sequence of a co-regulator peptide-containing polypeptide chain of a PPARγ CAR construct p51 (p51 bCW 492 myc anti-CD19 ON-switch part 1 with 1×SRC3 short co-regulator peptide and 4-1BB) is as follows:

(SEQ ID NO: 699)
MALPVTALLLPLALLLHAARPEQKLISEEDLDIQMTQTTSSLSASLGDR

VTISCRASQDISKYLNWYQQKPDGTVKLLIYHTSRLHSGVPSRFSGSGS

GTDYSLTISNLEQEDIATYFCQQGNTLPYTFGGGTKLEITGGGGSGGGG

SGGGGSEVKLQESGPGLVAPSQSLSVTCTVSGVSLPDYGVSWIRQPPRK

GLEWLGVIWGSETTYYNSALKSRLTIIKDNSKSQVFLKMNSLQTDDTAI

YYCAKHYYYGGSYAMDYWGQGTSVTVSSTTTPAPRPPTPAPTIASQPLS

LRPEACRPAAGGAVHTRGLDFACD<u>IYIWAPLAGTCGVLLLSLVITLY</u>CS

L*KRGRKKLLYIFKQPFMRPVQTTQEEDGCSCRFPEEEEGGCELS*RGSGS

GSTS<u>PKKENNALLRYLLDRDDPSDAGS</u>*, where the anti-CD19 sequence is in bold, the CD8α transmembrane (TM) domain is double underlined, the 4-1BB sequence is in italics and bold text, and the co-regulator peptide is underlined (single underline).

The amino acid sequence of the PPARγ CAR construct p52 (p52 bCW 494 myc aCD19 ON-switch part 1 with 1×SRC3 long co-regulator peptide and 4-1BB) is as follows:

(SEQ ID NO: 700)
MALPVTALLLPLALLLHAARPEQKLISEEDLDIQMTQTTSSLSASLGDR

VTISCRASQDISKYLNWYQQKPDGTVKLLIYHTSRLHSGVPSRFSGSGS

GTDYSLTISNLEQEDIATYFCQQGNTLPYTFGGGTKLEITGGGGSGGGG

SGGGGSEVKLQESGPGLVAPSQSLSVTCTVSGVSLPDYGVSWIRQPPRK

GLEWLGVIWGSETTYYNSALKSRLTIIKDNSKSQVFLKMNSLQTDDTAI

YYCAKHYYYGGSYAMDYWGQGTSVTVSSTTTPAPRPPTPAPTIASQPLS

LRPEACRPAAGGAVHTRGLDFACD<u>IYIWAPLAGTCGVLLLSLVITLY</u>CS

L*KRGRKKLLYFKQPFMRPQTTQEEDGCSCRFPEEEEGGCEL*

SRGSGSGSTS<u>MHGSLLQEKHRILHKLLQNGNSPAEVAKITAEATGKDTS</u>

<u>SITSCGDGNVVKQEQLSPKKKENNALLRYLLDRDDPSDAGS</u>*, where the anti-CD19 sequence is in bold, the CD8α transmembrane (TM) domain is double underlined, the 4-1BB sequence is in italics and bold text, and the co-regulator peptide is underlined (single underline).

The amino acid sequence of the PPARγ CAR construct p55 (p55 bCW493 dimeric myc aCD19 CD8a hinge TM 41BB linker 3× short SRC3 peptide in pHR) is as follows:

(SEQ ID NO: 701)
MALPVTALLLPLALLLHAARPEQKLISEEDLDIQMTQTTSSLSASLGDR

VTISCRASQDISKYLNWYQQKPDGTVKLLIYHTSRLHSGVPSRFSGSGS

GTDYSLTISNLEQEDIATYFCQQGNTLPYTFGGGTKLEITGGGSGGGG

SGGGGSEVKLQESGPGLVAPSQSLSVTCTVSGVSLPDYGVSWIRQPPRK

GLEWLGVIWGSETTYYNSALKSRLTIIKDNSKSQVFLKMNSLQTDDTAI

YYCAKHYYYGGSYAMDYWGQGTSVTVSSTTTPAPRPPTPAPTIASQPLS

LRPEACRPAAGGAVHTRGLDFACD<u>IYIWAPLAGTCGVLLLSLVITLY</u>CS

L*KRGRKKLLYIFKQPFMRPVQTTQEEDGCSCRFPEEEEGGCEL*SRGSGS

GSTS<u>PKKENNALLRYLLDRDDPSDAGGGSGGGSPKKENNALLRYLLDRD</u>

<u>DPSDAGGGSGGGSKKENNALLRYLLDRDDPSDAGS</u>*, where the anti-CD19 sequence is in bold, the CD8α transmembrane (TM) domain is double underlined, the 4-1BB sequence is in italics and bold text, and the co-regulator peptide is underlined (single underline).

The amino acid sequence of the PPARγ CAR construct P56 (p56 bCW495 Kozak dDAP10 CD8a TM-41BB-GS×8-PPARg LBD-GS×4-zeta-GS×4-mCherry in pHR) is as follows:

(SEQ ID NO: 702)
MIHLGHILFLLLLPVAAAQTTPGERSSLPAFYPGTSGSCSGCGSLSLP

<u>IYIWAPLAGTCGVLLLSLVITLYCS</u>L*KRGRKKLLYIFKQPFMRPVQTT*

*QEEDGCSCREPEEEEGGCEL*GSGSGSGSGSGSGSTSESADLRALAKHL

YDSYIKSFPLTKAKARAILTGKTTDKSPFVIYDMNSLMMGEDKIKFKH

ITPLQEQSKEVAIRIFQGCQFRSVEAVQEITEYAKSIPGFVNLDLNDQ

VTLLKYGVHEIIYTMLASLMNKDGVLISEGQGFMTREFLKSLRKPFGD

FMEPKFEFAVKFNALELDDSDLAIFIAVIILSGDRPGLLNVKPIEDIQ

DNLLQALELQLKLNHPESSQLFAKLLQKMTDLRQIVTEHVQLLQVIKK

TETDMSLHPLLQEIYKDLYGSGSGSGSSL*RVKFSRSADA*

*PAYQQGQNQLYNELNLGRREEYDVLDKRRGRDPEMGG*

*KPRRKNPQEGLYNELQKDKMAEAYSEIGMKGER*

*RRGKGHDGLYQGLSTATKDTYDALHMQALPPR*SRGSGSGSGSMV

SKGEEDNMAIIKEFMRFKVHMEGSVNGHEFEIEGEGEGRPYEGTQTAK

LKVTKGGPLPFAWDILSPQFMYGSKAYVKHPADIPDYLKLSFPEGFKW

ERVMNFEDGGVVTVTQDSSLQDGEFIYKVKLRGTNFPSDGPVMQKKTM

GWEASSERMYPEDGALKGEIKQRLKLKDGGHYDAEVKTTYKAKKPVQL

PGAYNVNIKLDITSHNEDYTIVEQYERAEGRHSTGGMDELYKCVTD*.

The LBD is underlined (single underline); the CD8α TM domain is double underlined; 4-1BB is in bold text; and zeta is in bold and italics.

Results

Figure 14:
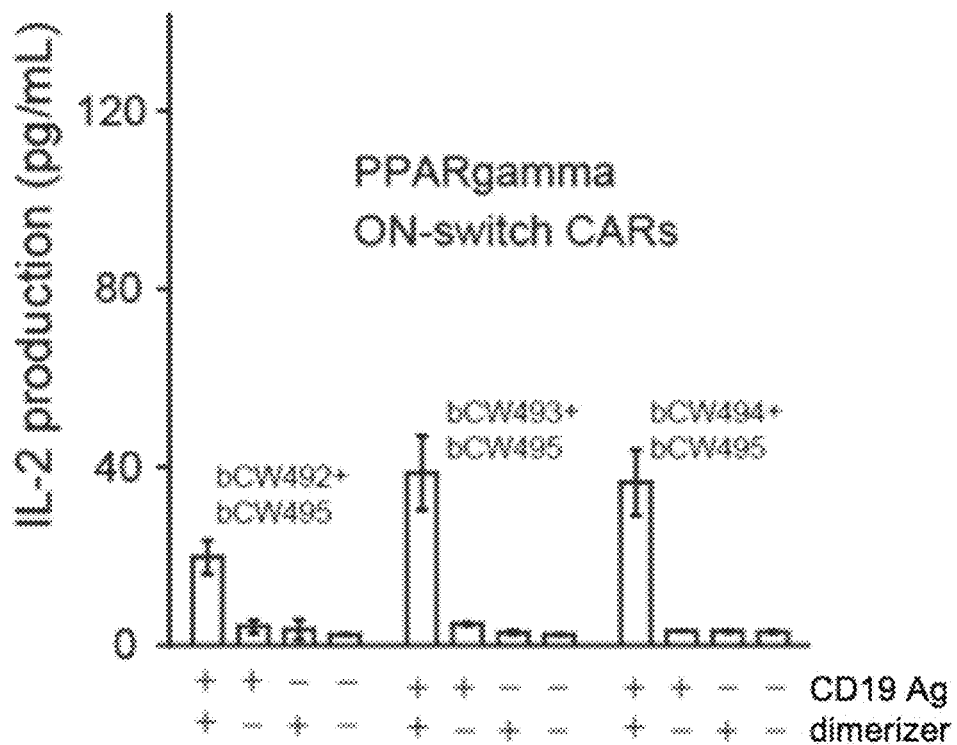
FIG. 14 depicts IL-2 cytokine production by ON-switch CAR+ Jurkat cells (transduced with the indicated lentiviral constructs) after 18 hours of co-culturing with K562 target cells (+/−CD19 Ag, as indicated), in the presence or absence of rosiglitazone dimerizer (10 micromolar).

FIG. 14 depicts IL-2 cytokine production by ON-switch CAR+ Jurkat cells (transduced with the indicated lentiviral constructs) after 18 hours of co-culturing with K562 target cells (+/−CD19 Ag, as indicated), in the presence or absence of rosiglitazone dimerizer (10 micromolar).

Example 2: ER-Alpha-Based on-Switch Car Constructs

Figure 15:
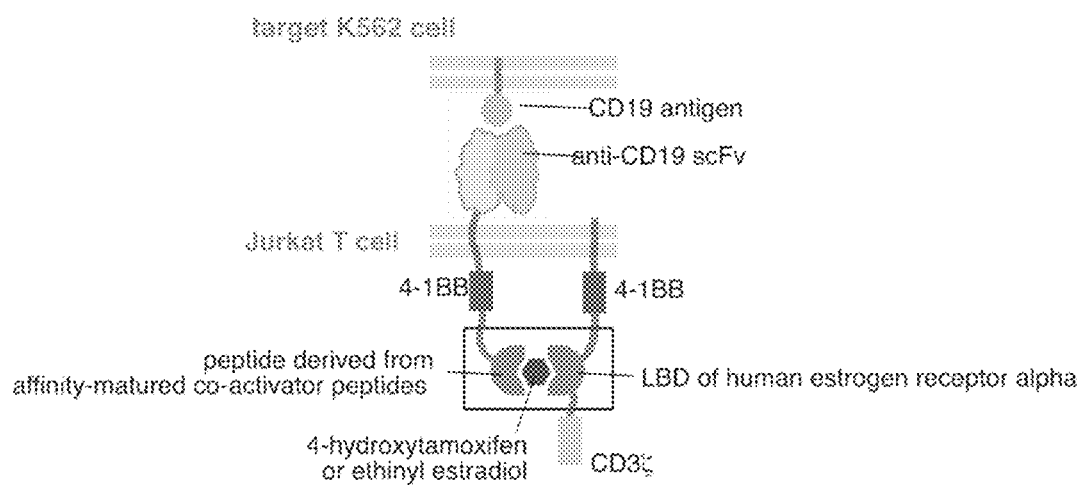
FIG. 15 is a schematic diagram of an estrogen receptor alpha-based ON-switch CAR construct.

ERα-based ON-switch CAR constructs were generated. FIG. 15 presents a schematic diagram of the overall structure of the constructs. Constructs are listed in Table 4. ON-switch constructs (bCW197, bCW206, bCW207), with FKBP and FRB* domains, were used as positive and negative control CARs.

TABLE 4

| construct ID # | encoded CAR molecule |
|---|---|
| bCW501 | Part 1 myc aCD19 ON-switch part 1 with 3x AlphaBetaV peptide and 4-1BB |
| bCW502 | Part 1 myc aCD19 ON-switch part 1 with 3x CoRNR peptide and 4-1BB |
| bCW503 | ON-switch CAR part 2 with human ER alpha LBD |
| bCW504 | ON-switch CAR part 2 with human ER alpha LBD w Y537F |
| bCW505 | ON-switch CAR part 2 with human ER alpha LBD w Y537F G521R |

Amino acid sequences of the various components of the ERα-based ON-switch CAR are as follows.

a. The LBD of human estrogen receptor alpha in construct bCW503:

(SEQ ID NO: 703)
DRRGGRMLKHKRQRDDGEGRGEVGSAGDMRAANLWPSPLMIKRSKKNSL

ALSLTADQMVSALLDAEPPILYSEYDPTRPFSEASMMGLLTNLADRELV

HMINWAKRVPGFVDLTLHDQVHLLECAWLEILMIGLVWRSMEHPGKLLF

APNLLLDRNQGKCVEGMVEIFDMLLATSSRFRMMNLQGEEFVCLKSIIL

LNSGVYTFLSSTLKSLEEKDHIHRVLDKITDTLIHLMAKAGLTLQQQHQ

RLAQLLLILSHIRHMSNKGMEHLYSMKCKNVVPLYDLLLEMLDAHRLHA

PTS;

b. The LBD of mutated human estrogen receptor alpha in construct bCW504:

(SEQ ID NO: 704)
DRRGGRMLKHKRQRDDGEGRGEVGSAGDMRAANLWPSPLMIKRSKKNSL

ALSLTADQMVSALLDAEPPILYSEYDPTRPFSEASMMGLLTNLADRELV

HMINWAKRVPGFVDLTLHDQVHLLECAWLEILMIGLVWRSMEHPGKLLF

APNLLLDRNQGKCVEGMVEIFDMLLATSSRFRMMNLQGEEFVCLKSIIL

LNSGVYTFLSSTLKSLEEKDHIHRVLDKITDTLIHLMAKAGLTLQQQHQ

RLAQLLLILSHIRHMSNKGMEHLYSMKCKNVVPLFDLLLEMLDAHRLHA

PTS;

c. The LBD of mutated human estrogen receptor alpha in construct bCW505:

(SEQ ID NO: 705)
DRRGGRMLKHKRQRDDGEGRGEVGSAGDMRAANLWPSPLMIKRSKKNSL

ALSLTADQMVSALLDAEPPILYSEYDPTRPFSEASMMGLLTNLADRELV

-continued

```
HMINWAKRVPGFVDLTLHDQVHLLECAWLEILMIGLVWRSMEHPGKLLF
APNLLLDRNQGKCVEGMVEIFDMLLATSSRFRMMNLQGEEFVCLKSIIL
LNSGVYTFLSSTLKSLEEKDHIHRVLDKITDTLIHLMAKAGLTLQQQHQ
RLAQLLLILSHIRHMSNKRMEHLYSMKCKNVVPLFDLLLEMLDAHRLHA
PTS;
``` d. The 3× AlphaBetaV co-activator peptide in bCW501:

(SEQ ID NO: 706)
```
SGSGPGSREWFKDMLGGGSGGGSSGSGPGSREWFKDMLGGGSGGGSSGS
GPGSREWFKDM;
``` e. The 3× CoRNR co-activator peptide in bCW502:

(SEQ ID NO: 707)
```
DAFQLRQLILRGLQDDGGGSGGGSDAFQLRQLILRGLQDDGGGSGGGSD
AFQLRQLILRGLQDD.
```

The amino acid sequence of the bCW501 construct (p25 bCW501 myc aCD19 ON-switch part 1 with 3× AlphaBetaV peptide and 4-1BB) is as follows:

(SEQ ID NO: 708)
```
MALPVTALLLPLALLLHAARPEQKLISEEDLDIQMTQTTSSLSASLGDR
VTISCRASQDISKYLNWYQQKPDGTVKLLIYHTSRLHSGVPSRFSGSGS
GTDYSLTISNLEQEDIATYFCQQGNTLPYTFGGGTKLEITGGGGSGGGG
SGGGGSEVKLQESGPGLVAPSQSLSVTCTVSGVSLPDYGVSWIRQPPRK
GLEWLGVIWGSETTYYNSALKSRLTIIKDNSKSQVFLKMNSLQTDDTAI
YYCAKHYYYGGSYAMDYWGQGTSVTVSSTTTPAPRPPTPAPTIASQPLS
LRPEACRPAAGGAVHTRGLDFACDIYIWAPLAGTCGVLLLSLVITLYCS
LKRGRKKLLYIFKQPFMRPVQTTQEEDGCSCRFPEEEEGGCELSRGSGS
GSTSSGSGPGSREWFKDMLGGGSGGGSSGSGPGSREWFKDMLGGGSGGG
SSGSGPGSREWFKDMLGS*,
``` where the co-regulator peptide αβV is underlined.

The amino acid sequence of the bCW502 construct (p26 bCW502 myc aCD19 ON-switch part 1 with 3× CoRNR peptide and 4-1BB) is as follows:

(SEQ ID NO: 709)
```
MALPVTALLLPLALLLHAARPEQKLISEEDLDIQMTQTTSSLSASLGDR
VTISCRASQDISKYLNWYQQKPDGTVKLLIYHTSRLHSGVPSRFSGSGS
GTDYSLTISNLEQEDIATYFCQQGNTLPYTFGGGTKLEITGGGGSGGGG
SGGGGSEVKLQESGPGLVAPSQSLSVTCTVSGVSLPDYGVSWIRQPPRK
GLEWLGVIWGSETTYYNSALKSRLTIIKDNSKSQVFLKMNSLQTDDTAI
YYCAKHYYYGGSYAMDYWGQGTSVTVSSTTTPAPRPPTPAPTIASQPLS
LRPEACRPAAGGAVHTRGLDFACDIYIWAPLAGTCGVLLLSLVITLYCS
LKRGRKKLLYIFKQPFMRPVQTTQEEDGCSCRFPEEEEGGCELSRGSGS
GSTSDAFQLRQLILRGLQDDGGGSGGGSDAFQLRQLILRGLQDDGGGSG
GGSDAFQLRQLILRGLQDDGS*,
``` where the 3× CoRNR co-regulator peptide is underlined.

The amino acid sequence of the bCW503 construct (p27 bCW503 ON-switch CAR part 2 with human ER alpha LBD) is as follows:

(SEQ ID NO: 710)
```
MIHLGHILFLLLLPVAAAQTTPGERSSLPAFYPGTSGSCSGCGSLSLPIY
IWAPLAGTCGVLLLSLVITLYCSLKRGRKKLLYIFKQPFMRPVQTTQEED
GCSCRFPEEEEGGCELGSGSGSGSGSGSGSTSDRRGGRMLKHKRQRDDGE
GRGEVGSAGDMRAANLWPSPLMIKRSKKNSLALSLTADQMVSALLDAEPP
ILYSEYDPTRPFSEASMMGLLTNLADRELVHMINWAKRVPGFVDLTLHDQ
VHLLECAWLEILMIGLVWRSMEHPGKLLFAPNLLLDRNQGKCVEGMVEIF
DMLLATSSRFRMMNLQGEEFVCLKSIILLNSGVYTFLSSTLKSLEEKDHI
HRVLDKITDTLIHLMAKAGLTLQQQHQRLAQLLLILSHIRHMSNKGMEHL
YSMKCKNVVPLYDLLLEMLDAHRLHAPTSGSGSGSGSSLRVKFSRSADAP
AYQQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPP
RSRGSGSGSGSMVSKGEEDNMAIIKEFMRFKVHMEGSVNGHEFEIEGEGE
GRPYEGTQTAKLKVTKGGPLPFAWDILSPQFMYGSKAYVKHPADIPDYLK
LSFPEGFKWERVMNFEDGGVVTVTQDSSLQDGEFIYKVKLRGTNFPSDGP
VMQKKTMGWEASSERMYPEDGALKGEIKQRLKLKDGGHYDAEVKTTYKAK
KPVQLPGAYNVNIKLDITSHNEDYTIVEQYERAEGRHSTGGMDELYKCVT
D*,
``` where the ER LBD is underlined.

The amino acid sequence of the bCW504 construct (p28 bCW504 ON-switch CAR part 2 with human ER alpha LBD w Y537F) is as follows:

(SEQ ID NO: 711)
```
MIHLGHILFLLLLPVAAAQTTPGERSSLPAFYPGTSGSCSGCGSLSLPIY
IWAPLAGTCGVLLLSLVITLYCSLKRGRKKLLYIFKQPFMRPVQTTQEED
GCSCRFPEEEEGGCELGSGSGSGSGSGSGSTSDRRGGRMLKHKRQRDDGE
GRGEVGSAGDMRAANLWPSPLMIKRSKKNSLALSLTADQMVSALLDAEPP
ILYSEYDPTRPFSEASMMGLLTNLADRELVHMINWAKRVPGFVDLTLHDQ
VHLLECAWLEILMIGLVWRSMEHPGKLLFAPNLLLDRNQGKCVEGMVEIF
DMLLATSSRFRMMNLQGEEFVCLKSIILLNSGVYTFLSSTLKSLEEKDHI
HRVLDKITDTLIHLMAKAGLTLQQQHQRLAQLLLILSHIRHMSNKGMEHL
YSMKCKNVVPLFDLLLEMLDAHRLHAPTSGSGSGSGSSLRVKFSRSADAP
AYQQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPP
RSRGSGSGSGSMVSKGEEDNMAIIKEFMRFKVHMEGSVNGHEFEIEGEGE
GRPYEGTQTAKLKVTKGGPLPFAWDILSPQFMYGSKAYVKHPADIPDYLK
```

-continued
LSFPEGFKWERVMNFEDGGVVTVTQDSSLQDGEFIYKVKLRGTNFPSDGP

VMQKKTMGWEASSERMYPEDGALKGEIKQRLKLKDGGHYDAEVKTTYKAK

KPVQLPGAYNVNIKLDITSHNEDYTIVEQYERAEGRHSTGGMDELYKCVT

D*, where the ERα LBD is underlined and the Y537F substitution is in bold.

The amino acid sequence of the bCW505 construct (p29 bCW505 ON-switch CAR part 2 with human ER alpha LBD w Y537F G521R) is as follows:

(SEQ ID NO: 712)
MIHLGHILFLLLLPVAAAQTTPGERSSLPAFYPGTSGSCSGCGSLSLPIY

IWAPLAGTCGVLLLSLVITLYCSLKRGRKKLLYIFKQPFMRPVQTTQEED

GCSCRFPEEEEGGCELGSGSGSGSGSGSGSTSD<u>RRGGRMLKHKRQRDDGE</u>

<u>GRGEVGSAGDMRAANLWPSPLMIKRSKKNSLALSLTADQMVSALLDAEPP</u>

<u>ILYSEYDPTRPFSEASMMGLLTNLADRELVHMINWAKRVPGFVDLTLHDQ</u>

<u>VHLLECAWLEILMIGLVWRSMEHPGKLLFAPNLLLDRNQGKCVEGMVEIF</u>

<u>DMLLATSSRFRMMNLQGEEFVCLKSIILLNSGVYTFLSSTLKSLEEKDHI</u>

<u>HRVLDKITDTLIHLMAKAGLTLQQQHQRLAQLLLILSHIRHMSNKRMEHL</u>

<u>YSMKCKNVVPLFDLLLEMLDAHRLHAPTSGSGSGSGSSLRVKFSRSADAP</u>

AYQQGQNQLYNELNLGRREEYDVLDKRRGRDPEMGGKPRRKNPQEGLYNE

LQKDKMAEAYSEIGMKGERRRGKGHDGLYQGLSTATKDTYDALHMQALPP

RSRGSGSGSGSMVSKGEEDNMAIIKEFMRFKVHMEGSVNGHEFEIEGEGE

GRPYEGTQTAKLKVTKGGPLPFAWDILSPQFMYGSKAYVKHPADIPDYLK

LSFPEGFKWERVMNFEDGGVVTVTQDSSLQDGEFIYKVKLRGTNFPSDGP

VMQKKTMGWEASSERMYPEDGALKGEIKQRLKLKDGGHYDAEVKTTYKAK

KPVQLPGAYNVNIKLDITSHNEDYTIVEQYERAEGRHSTGGMDELYKCVT

D*, where the ERα LBD is underlined, and the Y536F and G521R substitutions are in bold.

The amino acid sequence of the bCW506 construct (p30 bCW506 ON-switch CAR part 2 with human ER alpha LBD w/o helix 12) is as follows:

(SEQ ID NO: 713)
MIHLGHILFLLLLPVAAAQTTPGERSSLPAFYPGTSGSCSGCGSLSLPIY

IWAPLAGTCGVLLLSLVITLYCSLKRGRKKLLYIFKQPFMRPVQTTQEED

GCSCRFPEEEEGGCELGSGSGSGSGSGSGSTSD<u>RRGGRMLKHKRQRDDGE</u>

<u>GRGEVGSAGDMRAANLWPSPLMIKRSKKNSLALSLTADQMVSALLDAEPP</u>

<u>ILYSEYDPTRPFSEASMMGLLTNLADRELVHMINWAKRVPGFVDLTLHDQ</u>

<u>VHLLECAWLEILMIGLVWRSMEHPGKLLFAPNLLLDRNQGKCVEGMVEIF</u>

<u>DMLLATSSRFRMMNLQGEEFVCLKSIILLNSGVYTFLSSTLKSLEEKDHI</u>

<u>HRVLDKITDTLIHLMAKAGLTLQQQHQRLAQLLLILSHIRHMSNKGMEHL</u>

<u>YSMKCKNVAGSGSGSGSSLRVKFSRSADAPAYQQGQNQLYNELNLGRREE</u>

<u>YDVLDKRRGRDPEMGGKPRRKNPQEGLYNELQKDKMAEAYSEIGMKGERR</u>

-continued
RGKGHDGLYQGLSTATKDTYDALHMQALPPRSRGSGSGSGSMVSKGEEDN

MAIIKEFMRFKVHMEGSVNGHEFEIEGEGEGRPYEGTQTAKLKVTKGGPL

PFAWDILSPQFMYGSKAYVKHPADIPDYLKLSFPEGFKWERVMNFEDGGV

VTVTQDSSLQDGEFIYKVKLRGTNFPSDGPVMQKKTMGWEASSERMYPED

GALKGEIKQRLKLKDGGHYDAEVKTTYKAKKPVQLPGAYNVNIKLDITSH

NEDYTIVEQYERAEGRHSTGGMDELYKCVTD*, where the ERα LBD (without helix 12) is underlined.

The amino acid sequence of the bCW507 construct (p31 bCW507 ON-switch CAR part 2 with human ER alpha LBD w/o helix 12 w G521R) is as follows:

(SEQ ID NO: 714)
MIHLGHILFLLLLPVAAAQTTPGERSSLPAFYPGTSGSCSGCGSLSLPIY

IWAPLAGTCGVLLLSLVITLYCSLKRGRKKLLYIFKQPFMRPVQTTQEED

GCSCRFPEEEEGGCELGSGSGSGSGSGSGSTSD<u>RRGGRMLKHKRQRDDGE</u>

<u>GRGEVGSAGDMRAANLWPSPLMIKRSKKNSLALSLTADQMVSALLDAEPP</u>

<u>ILYSEYDPTRPFSEASMMGLLTNLADRELVHMINWAKRVPGFVDLTLHDQ</u>

<u>VHLLECAWLEILMIGLVWRSMEHPGKLLFAPNLLLDRNQGKCVEGMVEIF</u>

<u>DMLLATSSRFRMMNLQGEEFVCLKSIILLNSGVYTFLSSTLKSLEEKDHI</u>

<u>HRVLDKITDTLIHLMAKAGLTLQQQHQRLAQLLLILSHIRHMSNKRMEHL</u>

<u>YSMKCKNVAGSGSGSGSSLRVKFSRSADAPAYQQGQNQLYNELNLGRREE</u>

YDVLDKRRGRDPEMGGKPRRKNPQEGLYNELQKDKMAEAYSEIGMKGERR

RGKGHDGLYQGLSTATKDTYDALHMQALPPRSRGSGSGSGSMVSKGEEDN

MAIIKEFMRFKVHMEGSVNGHEFEIEGEGEGRPYEGTQTAKLKVTKGGPL

PFAWDILSPQFMYGSKAYVKHPADIPDYLKLSFPEGFKWERVMNFEDGGV

VTVTQDSSLQDGEFIYKVKLRGTNFPSDGPVMQKKTMGWEASSERMYPED

GALKGEIKQRLKLKDGGHYDAEVKTTYKAKKPVQLPGAYNVNIKLDITSH

NEDYTIVEQYERAEGRHSTGGMDELYKCVTD*, where the ERα LBD (without helix 12) is underlined, and the G521R substitution is in bold.

The amino acid sequence of the construct referred to as "p40 dimeric myc aCD19 CD8a hinge TM 41BB linker 3×NROB1 peptide in pHR" is as follows:

(SEQ ID NO: 715)
MALPVTALLLPLALLLHAARPEQKLISEEDLDIQMTQTTSSLSASLGDRV

TISCRASQDISKYLNWYQQKPDGTVKLLIYHTSRLHSGVPSRFSGSGSGT

DYSLTISNLEQEDIATYFCQQGNTLPYTFGGGTKLEITGGGGSGGGGSGG

GGSEVKLQESGPGLVAPSQSLSVTCTVSGVSLPDYGVSWIRQPPRKGLEW

LGVIWGSETTYYNSALKSRLTIIKDNSKSQVFLKMNSLQTDDTAIYYCAK

HYYYGGSYAMDYWGQGTSVTVSSTTTPAPRPPTPAPTIASQPLSLRPEAC

RPAAGGAVHTRGLDFACDIYIWAPLAGTCGVLLLSLVITLYCSLKRGRKK

LLYIFKQPFMRPVQTTQEEDGCSCRFPEEEEGGCELSRGSGSGSTSPRQG

SILYSMLTSAKQTGGGSGGGS<u>PRQGSILYSMLTSAKQTGGGSGGGSPRQG</u>

<u>SILYSMLTSAKQTGS</u>*, where the 3×NROB1 co-regulator peptide is underlined.

The amino acid sequence of the construct referred to as "p41 dimeric myc aCD19 CD8a hinge TM 41BB linker 3×NCOA1 peptide in pHR" is as follows:

(SEQ ID NO: 716)
MALPVTALLLPLALLLHAARPEQKLISEEDLDIQMTQTTSSLSASLGDRV
TISCRASQDISKYLNWYQQKPDGTVKLLIYHTSRLHSGVPSRFSGSGSGT
DYSLTISNLEQEDIATYFCQQGNTLPYTFGGGTKLEITGGGGSGGGGSGG
GGSEVKLQESGPGLVAPSQSLSVTCTVSGVSLPDYGVSWIRQPPRKGLEW
LGVIWGSETTYYNSALKSRLTIIKDNSKSQVFLKMNSLQTDDTAIYYCAK
HYYYGGSYAMDYWGQGTSVTVSSTTTPAPRPPTPAPTIASQPLSLRPEAC
RPAAGGAVHTRGLDFACDIYIWAPLAGTCGVLLLSLVITLYCSLKRGRKK
LLYIFKQPFMRPVQTTQEEDGCSCRFPEEEEGGCELSRGSGSGSTSLTER
HKILHRLLQEGSPSDGGGSGGGS<u>LTERHKILHRLLQEGSPSDGGGSGGGS
LTERHKILHRLLQEGSPSDGS</u>, where the 3×NCOA1 peptide is underlined.

The amino acid sequence of the construct referred to as "p42 dimeric myc aCD19 CD8a hinge TM 41BB linker 3×NCOA2 peptide in pHR" is as follows:

(SEQ ID NO: 717)
MALPVTALLLPLALLLHAARPEQKLISEEDLDIQMTQTTSSLSASLGDRV
TISCRASQDISKYLNWYQQKPDGTVKLLIYHTSRLHSGVPSRFSGSGSGT
DYSLTISNLEQEDIATYFCQQGNTLPYTFGGGTKLEITGGGGSGGGGSGG
GGSEVKLQESGPGLVAPSQSLSVTCTVSGVSLPDYGVSWIRQPPRKGLEW
LGVIWGSETTYYNSALKSRLTIIKDNSKSQVFLKMNSLQTDDTAIYYCAK
HYYYGGSYAMDYWGQGTSVTVSSTTTPAPRPPTPAPTIASQPLSLRPEAC
RPAAGGAVHTRGLDFACDIYIWAPLAGTCGVLLLSLVITLYCSLKRGRKK
LLYIFKQPFMRPVQTTQEEDGCSCRFPEEEEGGCELSRGSGSGSTSSKGQ
TKLLQLLTTKSDQGGGSGGGS<u>SKGQTKLLQLLTTKSDQGGGSGGGSSKGQ
TKLLQLLTTKSDQGS</u>*, where the 3×NCOA2 peptide is underlined.

The amino acid sequence of the construct referred to as "p43 dimeric myc aCD19 CD8a hinge TM 41BB linker 3×PGC-1 peptide in pHR" is as follows:

(SEQ ID NO: 718)
MALPVTALLLPLALLLHAARPEQKLISEEDLDIQMTQTTSSLSASLGDRVT
ISCRASQDISKYLNWYQQKPDGTVKLLIYHTSRLHSGVPSRFSGSGSGTDY
SLTISNLEQEDIATYFCQQGNTLPYTFGGGTKLEITGGGGSGGGGSGGGGS
EVKLQESGPGLVAPSQSLSVTCTVSGVSLPDYGVSWIRQPPRKGLEWLGVI
WGSETTYYNSALKSRLTIIKDNSKSQVFLKMNSLQTDDTAIYYCAKHYYYG
GSYAMDYWGQGTSVTVSSTTTPAPRPPTPAPTIASQPLSLRPEACRPAAGG
AVHTRGLDFACDIYIWAPLAGTCGVLLLSLVITLYCSLKRGRKKLLYIFKQ
PFMRPVQTTQEEDGCSCRFPEEEEGGCELSRGSGSGST<u>SAEEPSLLKKLLL
APANTGGGSGGGSAEEPSLLKKLLLAPANTGGGSGGGSAEEPSLLKKLLLA
PANT</u>GS*, where the 3×PGC-1 peptide is underlined.

The amino acid sequence of the construct referred to as "p44 dimeric myc aCD19 CD8a hinge TM 41BB linker 3×NRIP1 peptide in pHR" is as follows:

(SEQ ID NO: 719)
MALPVTALLLPLALLLHAARPEQKLISEEDLDIQMTQTTSSLSASLGDRV
TISCRASQDISKYLNWYQQKPDGTVKLLIYHTSRLHSGVPSRFSGSGSGT
DYSLTISNLEQEDIATYFCQQGNTLPYTFGGGTKLEITGGGGSGGGGSGG
GGSEVKLQESGPGLVAPSQSLSVTCTVSGVSLPDYGVSWIRQPPRKGLEW
LGVIWGSETTYYNSALKSRLTIIKDNSKSQVFLKMNSLQTDDTAIYYCAK
HYYYGGSYAMDYWGQGTSVTVSSTTTPAPRPPTPAPTIASQPLSLRPEAC
RPAAGGAVHTRGLDFACDIYIWAPLAGTCGVLLLSLVITLYCSLKRGRKK
LLYIFKQPFMRPVQTTQEEDGCSCRFPEEEEGGCELSRGSGSGSTSAANN
SLLLHLLKSQTIPGGGSGGGS<u>AANNSLLLHLLKSQTIPGGGSGGGSAANN
SLLLHLLKSQTIPGS</u>*, where the 3×NRIP1 peptide is underlined.

The amino acid sequence of the construct referred to as "p45 Kozak dDAP10 CD8a TM-41BB-GS×8-ERb LBD-GS×4-zeta-GS×4-mCherry in pHR" is as follows:

(SEQ ID NO: 720)
MIHLGHILFLLLLPVAAAQTTPGERSSLPAFYPGTSGSCSGCGSLSLPIY
IWAPLAGTCGVLLLSLVITLYCSLKRGRKKLLYIFKQPFMRPVQTTQEED
GCSCRFPEEEEGGCELGSGSGSGSGSGSGSTSVKCGSRRERCGYRLVRRQ
<u>RSADEQLHCAGKAKRSGGHAPRVRELLLDALSPEQLVLTLLEAEPPHVLI
SRPSAPFTEASMMMSLTKLADKELVHMISWAKKIPGFVELSLFDQVRLLE
SCWMEVLMMGLMWRSIDHPGKLIFAPDLVLDRDEGKCVEGILEIFDMLLA
TTSRFRELKLQHKEYLCVKAMILLNSSMYPLVTATQDADSSRKLAHLLNA
VTDALVWVIAKSGISSQQQSMRLANLLMLLSHVRHASNKGMEHLLNMKCK
NVVPVYDLLLEMLNAHVLRGCKSSITGSECSPAEDSKSKEGSQNPQGSGS</u>
GSGSSLRVKFSRSADAPAYQQGQNQLYNELNLGRREEYDVLDKRRGRDPE
MGGKPRRKNPQEGLYNELQKDKMAEAYSEIGMKGERRRGKHDGLYQGLS
TATKDTYDALHMQALPPRSRGSGSGSGSMVSKGEEDNMAIIKEFMRFKVH
MEGSVNGHEFEIEGEGEGRPYEGTQTAKLKVTKGGPLPFAWDILSPQFMY
GSKAYVKHPADIPDYLKLSFPEGFKWERVMNFEDGGVVTVTQDSSLQDGE
FIYKVKLRGTNFPSDGPVMQKKTMGWEASSERMYPEDGALKGEIKQRLKL
KDGGHYDAEVKTTYKAKKPVQLPGAYNVNIKLDITSHNEDYTIVEQYERA
EGRHSTGGMDELYKCVTD*, where the ERβ LBD is underlined.

The amino acid sequence of the construct referred to as "p179 dimeric myc aCD19 CD8a hinge TM 41BB linker 3×SRC-1 NRIV peptide in pHR" is as follows:

(SEQ ID NO: 721)
MALPVTALLLPLALLLHAARPEQKLISEEDLDIQMTQTTSSLSASLGDRV

TISCRASQDISKYLNWYQQKPDGTVKLLIYHTSRLHSGVPSRFSGSGSGT

DYSLTISNLEQEDIATYFCQQGNTLPYTFGGGTKLEITGGGGSGGGGSGG

GGSEVKLQESGPGLVAPSQSLSVTCTVSGVSLPDYGVSWIRQPPRKGLEW

LGVIWGSETTYYNSALKSRLTIIKDNSKSQVFLKMNSLQTDDTAIYYCAK

HYYYGGSYAMDYWGQGTSVTVSSTTTPAPRPPTPAPTIASQPLSLRPEAC

RPAAGGAVHTRGLDFACDIYIWAPLAGTCGVLLLSLVITLYCSLKRGRKK

LLYIFKQPFMRPVQTTQEEDGCSCRFPEEEEGGCELSRGSGSGSTSQAQQ

KSLLQQLLTEGGGSGGGSQAQQKSLLQQLLTEGGGSGGGSQAQQKSLLQQ

LLTEGS*, where the 3×NRIV1 peptide is underlined

Results

Figure 16A:
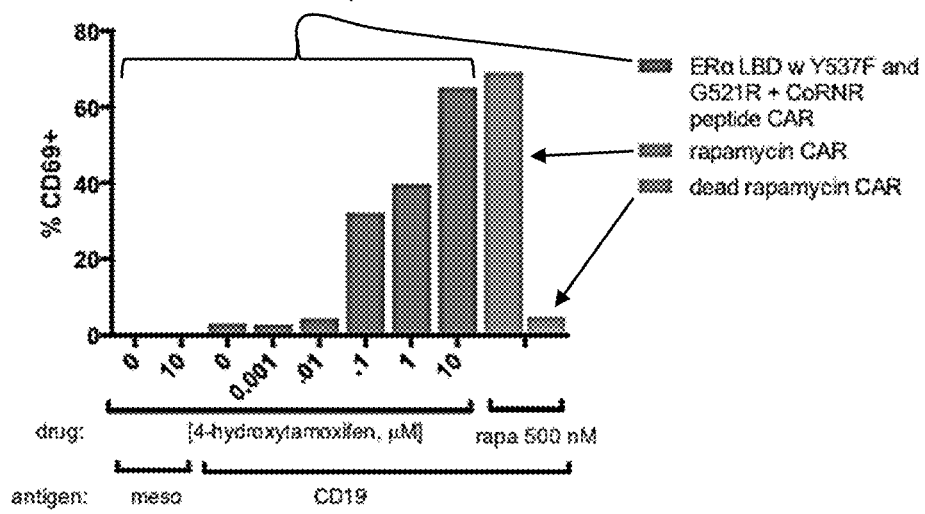
FIGS. 16A-16B depict CD69 upregulation by ER CAR+ Jurkat cells after 24 hours of co-culturing with K562 target cells expressing CD19 or an irrelevant antigen ("meso"), in the presence or absence of a small-molecule dimerizer (4-hydroxytamoxifen or rapalog AP21967). CD69 expression in ER CAR+ Jurkat cells is strongly induced by 4-hydroxytamoxifen (EC50~100 nM) only in the presence of K562 cells expressing CD19. Rapamycin CAR and dead rapamycin CAR were tested as positive and negative controls, respectively. Dead rapamycin CAR comprises a mutation in the ITAM domain such that it does not signal. The data series presented in FIG. 16B from back to front are CD19 antigen+4-hydroxytamoxifen 10 μM, 1 μM, 100 nM, 10 nM, 1 nM, 0 nM, meso antigen+10 μM rapalog, and meso antigen+0 μM rapalog.
Figure 16B:
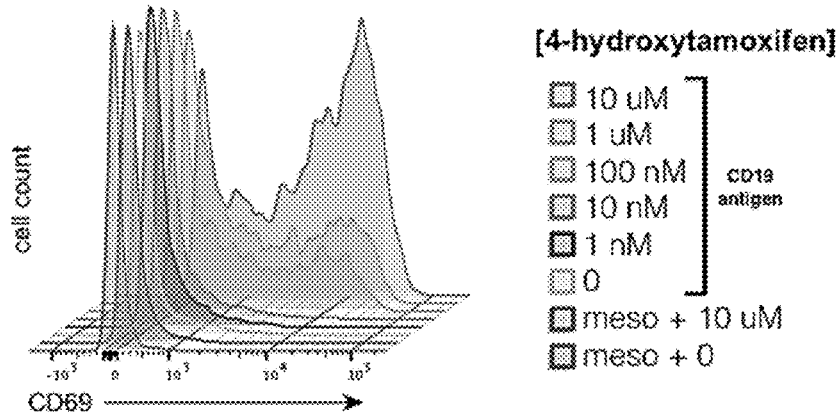

The data are depicted in FIG. 16A and FIG. 16B. FIG. 16A. CD69 upregulation by Jurkat cells expressing ER CAR+ (bCW502 and bCW505) after 24 hours of co-culturing with K562 target cells expressing CD19 or mesothelin, an irrelevant antigen ("meso"), in the presence or absence of a small-molecule dimerizer (4-hydroxytamoxifen or rapalog AP21967). CD69 expression in ER CAR+Jurkat cells is strongly induced by 4-hydroxytamoxifen (EC50~100 nM) only in the presence of K562 cells expressing CD19. Rapamycin CAR and dead rapamycin CAR (with a mutation in ITAM that abolishes signalling) were tested as positive and negative controls, respectively. FIG. 16B. FACS data from the experiment described in FIG. 16A, showing CD69 upregulation in ER CAR+ Jurkat cells in a manner dependent on CD19 antigen and treatment with 4-hydroxytamoxifen.

Example 3: Dimerizer Controlled Activation of Primary Human T Cells

Control of cellular functions by induced heterodimerization of the ligand binding domain of human estrogen receptor beta with small peptides derived from transcriptional co-repressors in the presence of the drug 4-hydroxytamoxifen was evaluated. This method does not involve DNA-binding and/or transcriptional activation or any DNA-binding function or transcription activating function of the human estrogen receptor beta from which polypeptide components are derived.

Figure 17:
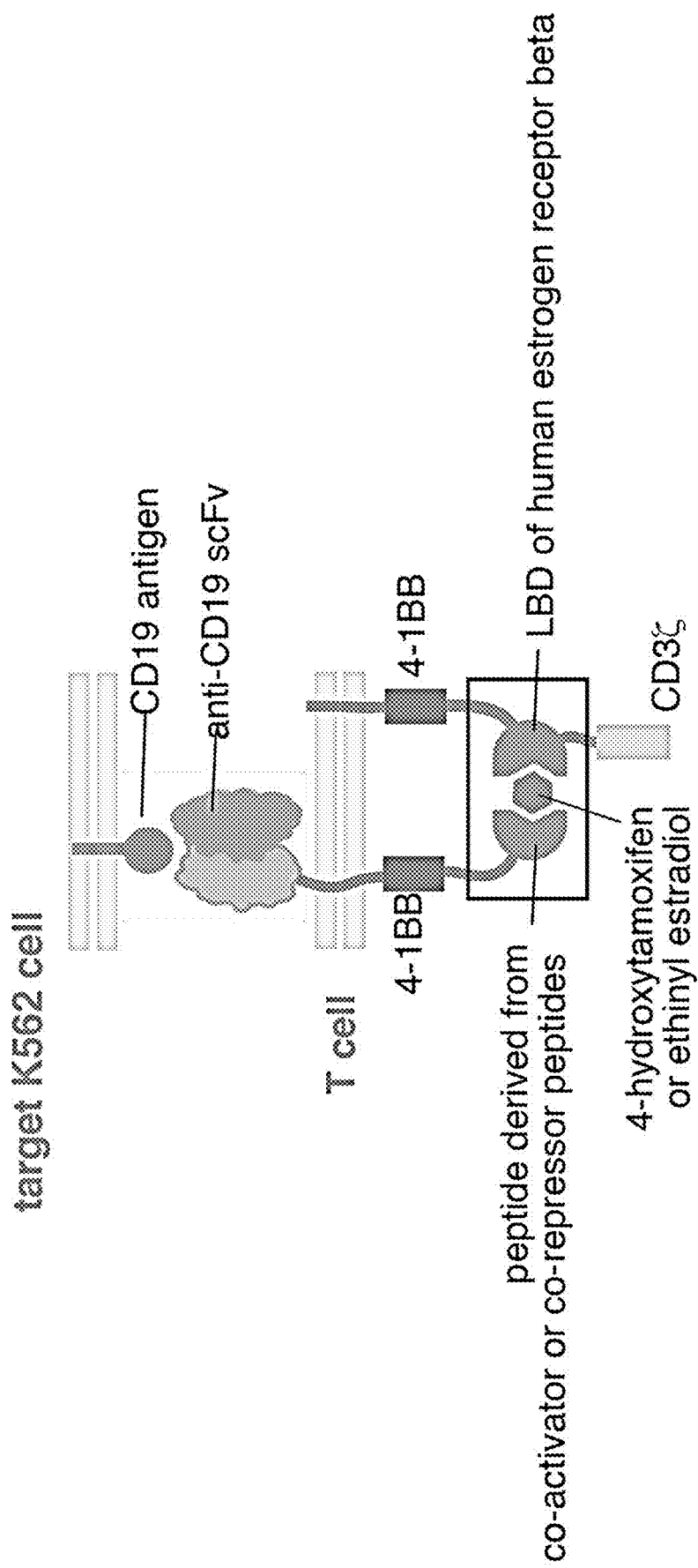
FIG. 17 provides a schematic diagram of an estrogen receptor beta-based ON-switch CAR construct.

A human estrogen receptor beta nuclear receptor-peptide system was expressed in primary human T cells and found to capable of modulating ON-switch CAR activity. A CD19 specific ON-switch CAR was constructed to include human estrogen receptor beta ligand binding domain and co-repressor peptide (CoRNR). A schematic representation of the general construct within the T cell membrane, and the associated CD19 antigen expressed on the surface of the target cell, is provided in FIG. 17. Upon introduction into primary CD8+ T cells, stable expression was observed and transduced cells displaced increased T cell activation upon addition of the drug 4-hyroxytamoxifen.

Nucleic acid sequences encoding the following constructs were employed: "p26 bCW 502 myc aCD19 ON-switch part 1 with 3× CoRNR peptide and 4-1BB" having the following sequence:

(SEQ ID NO: 722)
MALPVTALLLPLALLLHAARPEQKLISEEDLDIQMTQTTSSLSASLGDRV

TISCRASQDISKYLNWYQQKPDGTVKLLIYHTSRLHSGVPSRFSGSGSGT

DYSLTISNLEQEDIATYFCQQGNTLPYTFGGGTKLEITGGGGSGGGGSGG

GGSEVKLQESGPGLVAPSQSLSVTCTVSGVSLPDYGVSWIRQPPRKGLEW

LGVIWGSETTYYNSALKSRLTIIKDNSKSQVFLKMNSLQTDDTAIYYCAK

HYYYGGSYAMDYWGQGTSVTVSSTTTPAPRPPTPAPTIASQPLSLRPEAC

RPAAGGAVHTRGLDFACDIYIWAPLAGTCGVLLLSLVITLYCSLKRGRKK

LLYIFKQPFMRPVQTTQEEDGCSCRFPEEEEGGCELSRGSGSGSTSDAFQ

LRQLILRGLQDDGGGSGGGSDAFQLRQLILRGLQDDGGGSGGGSDAFQLR

QLILRGLQDDGS*, where the 3× CoRNR co-regulator peptide is underlined, and "p45 Kozak dDAP10 CD8a TM-41BB-GS×8-ERb LBD-GS×4-zeta-GS×4-mCherry in pHR" having the following sequence:

(SEQ ID NO: 723)
MIHLGHILFLLLLPVAAAQTTPGERSSLPAFYPGTSGSCSGCGSLSLPIY

IWAPLAGTCGVLLLSLVITLYCSLKRGRKKLLYIFKQPFMRPVQTTQEED

GCSCRFPEEEEGGCELGSGSGSGSGSGSGSTSVKCGSRRERCGYRLVRRQ

RSADEQLHCAGKAKRSGGHAPRVRELLLDALSPEQLVLTLLEAEPPHVLI

SRPSAPFTEASMMMSLTKLADKELVHMISWAKKIPGFVELSLFDQVRLLE

SCWMEVLMMGLMWRSIDHPGKLIFAPDLVLDRDEGKCVEGILEIFDMLLA

TTSRFRELKLQHKEYLCVKAMILLNSSMYPLVTATQDADSSRKLAHLLNA

VTDALVWVIAKSGISSQQQSMRLANLLMLLSHVRHASNKGMEHLLNMKCK

NVVPVYDLLLEMLNAHVLRGCKSSITGSECSPAEDSKSKEGSQNPQSQGS

GSGSGSSLRVKFSRSADAPAYQQGQNQLYNELNLGRREEYDVLDKRRGRD

PEMGGKPRRKNPQEGLYNELQKDKMAEAYSEIGMKGERRRGKGHDGLYQG

LSTATKDTYDALHMQALPPRSRGSGSGSGSMVSKGEEDNMAIIKEFMRFK

VHMEGSVNGHEFEIEGEGEGRPYEGTQTAKLKVTKGGPLPFAWDILSPQF

MYGSKAYVKHPADIPDYLKLSFPEGFKWERVMNFEDGGVVTVTQDSSLQD

GEFIYKVKLRGTNFPSDGPVMQKKTMGWEASSERMYPEDGALKGEIKQRL

KLKDGGHYDAEVKTTYKAKKPVQLPGAYNVNIKLDITSHNEDYTIVEQYE

RAEGRHSTGGMDELYKCVTD*, where the ERβ LBD is underlined.

Figure 18A:
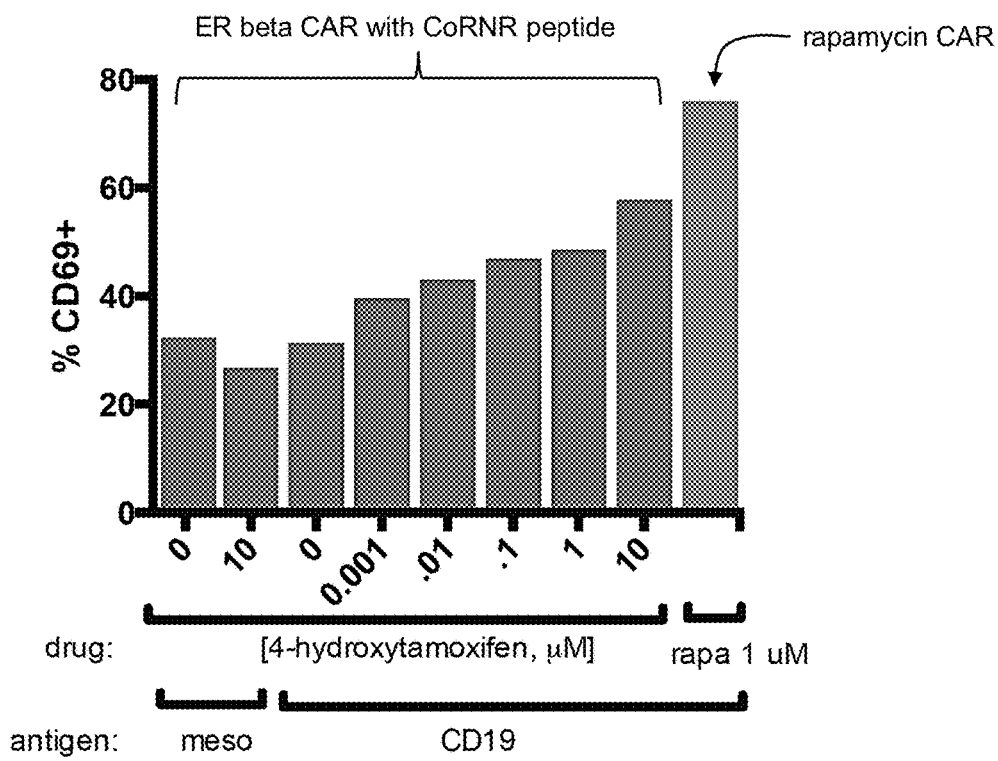
FIGS. 18A-18B depict CD69 upregulation by primary human T cells expressing ER-beta/CoRNR-based on-switch CAR measured after 24 hours of co-culturing with K562 target cells expressing CD19 or an irrelevant antigen ("meso"), in the presence or absence of a small-molecule dimerizer (4-hydroxytamoxifen or rapalog). CD69 expression is induced in a dimerizer dose dependent manner. The data series presented in FIG. 18B from back to front are CD19 antigen+4-hydroxytamoxifen 10 μM, 1 μM, 100 nM, 10 nM, 1 nM, 0 nM, meso antigen+10 μM rapalog, and meso antigen+0 μM rapalog.
Figure 18B:
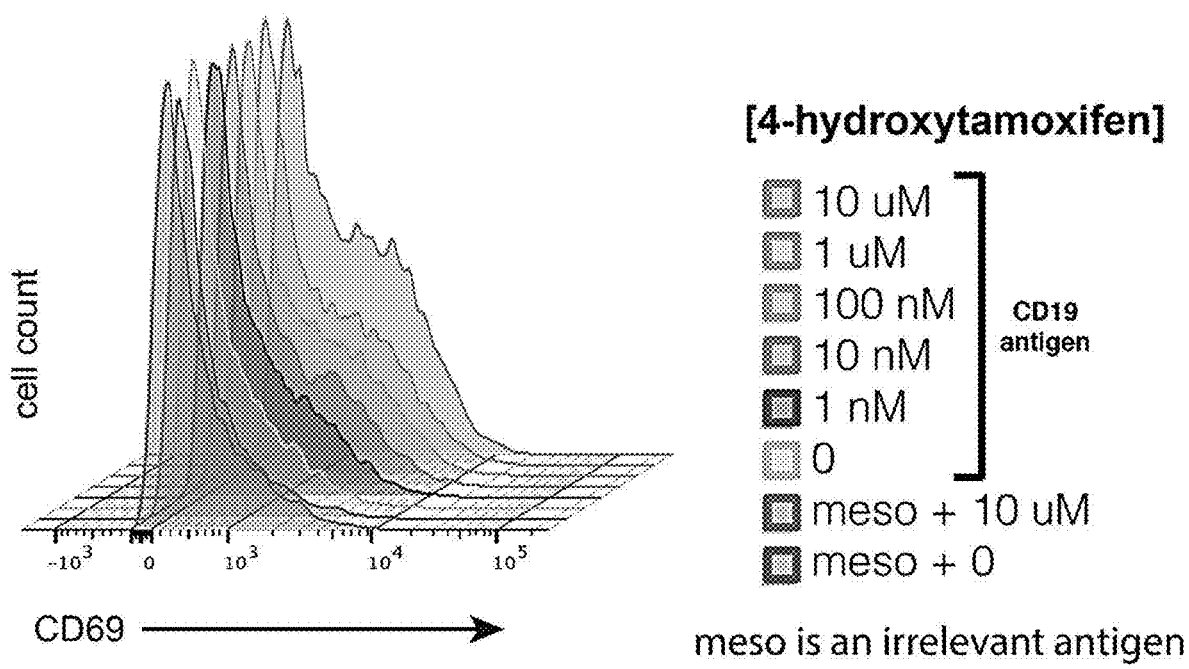

Specifically, CD69 upregulation by primary human CD8+ T cells expressing a CD19 specific ON-switch CAR constructed to include human estrogen receptor beta ligand binding domain (ER-beta) and co-repressor peptide (CoRNR) was measured after 24 hours of co-culturing with K562 target cells expressing CD19 or mesothelin, an irrelevant antigen ("meso"), in the presence or absence of a small-molecule dimerizer (4-hydroxytamoxifen or rapalog "rapa"). As shown in FIG. 18A, CD19-antigen induced activation of the primary human CD8+ T cells expressing the ER-beta/CoRNR on-switch CAR construct was dependent on the dose of small-molecule dimerizer provided to the culture. Histograms derived from the flow cytometery data, showing the correlation between increasing 4-hydroxytamoxifen dose and increasing numbers of CD69 positive primary human CD8+ T cells, are provided in FIG. 18B.

Figure 52:
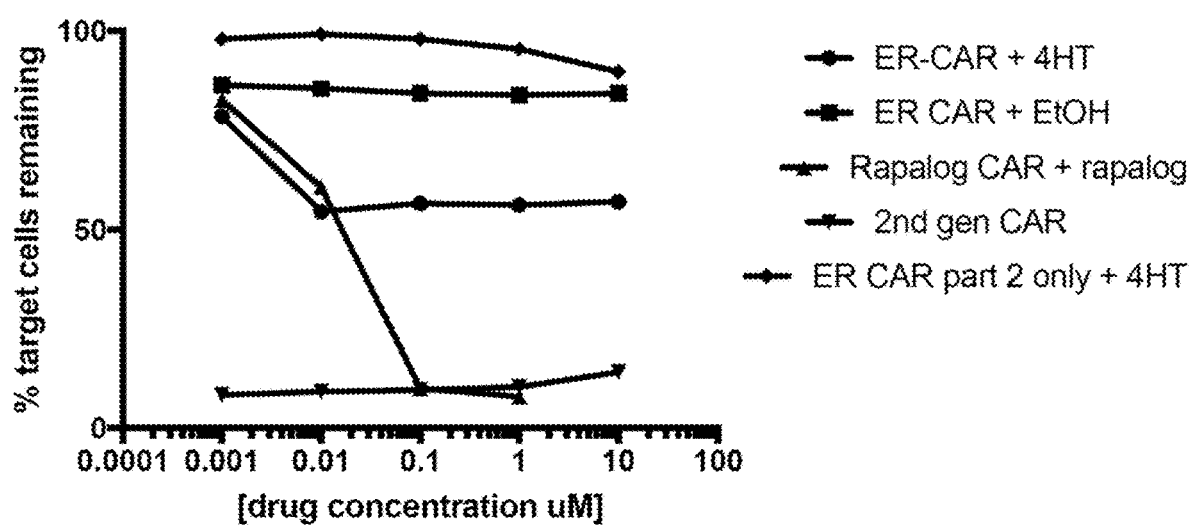
FIG. 52 depicts target cell killing by primary human CD8+ T cells expressing a CD19 specific ER-beta/CoRNR ON-switch CAR.

Cell killing by primary human CD8+ T cells expressing the CD19 specific ER-beta/CoRNR ON-switch CAR was also assessed. Specifically, the percent of CD19-expressing K562 target cells remaining after 22 hours of co-culture with primary human CD8+ T cells expressing the CD19 specific ER-beta/CoRNR ON-switch CAR (ER-CAR) in the presence of various concentrations of drug (4-hydroxytamoxifen (4HT) or rapalog) was measured (FIG. 52). Cells expressing a CD19 specific single-chain second generation CAR ("2$^{nd}$ gen CAR") and cells expressing a CD19 specific rapalog on-switch CAR, with administered rapalog dimerizer, were used as positive controls. Negative controls included cells expressing ER-CAR T cells in absence of 4HT (ethanol vehicle only, "ER-CAR+EtOH") and cells expressing only part 2 of the ER-CAR on-switch construct, i.e., without part 1, in the presence of 4HT. These results demonstrate drug (4HT) inducible target cell killing (i.e., inducible cytotoxic activity) by primary T cells expressing an ER-beta/CoRNR dimerizable ON-switch CAR.

Increased T cell activation was also observed in primary CD8+ T cells expressing a split ON-switch CAR construct in which the heterodimerization modules consisted of a portion of the human Vitamin D receptor ligand binding domain and a SRC2-3 coactivator peptide. In this system, the T cells showed increased activation in the presence of the vitamin D analog calcipotriol.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (723 sequences)

SEQ ID NO: 1 - protein, 25 aa, Artificial sequence
  synthetic amino acid sequence
CPSSHSSLTERHKILHRLLQEGSPS

SEQ ID NO: 2 - protein, 21 aa, Artificial sequence
  synthetic amino acid sequence
SLTARHKILHRLLQEGSPSDI

SEQ ID NO: 3 - protein, 19 aa, Artificial sequence
  synthetic amino acid sequence
ESKGHKKLLQLLTCSSDDR

SEQ ID NO: 4 - protein, 21 aa, Artificial sequence
  synthetic amino acid sequence
PKKENNALLRYLLDRDDPSDV

SEQ ID NO: 5 - protein, 17 aa, Artificial sequence
  synthetic amino acid sequence
AEEPSLLKKLLLAPANT

SEQ ID NO: 6 - protein, 21 aa, Artificial sequence
  synthetic amino acid sequence
QEAEEPSLLKKLLLAPANTQL

SEQ ID NO: 7 - protein, 21 aa, Artificial sequence
  synthetic amino acid sequence
SKVSQNPILTSLLQITGNGGS

SEQ ID NO: 8 - protein, 25 aa, Artificial sequence
  synthetic amino acid sequence
GHSFADPASNLGLEDIIRKALMGSF

SEQ ID NO: 9 - protein, 17 aa, Artificial sequence
  synthetic amino acid sequence
PRQGSILYSMLTSAKQT

SEQ ID NO: 10 - protein, 17 aa, Artificial sequence
  synthetic amino acid sequence
AANNSLLLHLLKSQTIP

SEQ ID NO: 11 - protein, 21 aa, Artificial sequence
  synthetic amino acid sequence
PKKKENALLRYLLDKDDTKDI

SEQ ID NO: 12 - protein, 16 aa, Artificial sequence
  synthetic amino acid sequence
DAFQLRQLILRGLQDD

SEQ ID NO: 13 - protein, 13 aa, Artificial sequence
  synthetic amino acid sequence
SPGSREWFKDMLS

SEQ ID NO: 14 - protein, 21 aa, Artificial sequence
  synthetic amino acid sequence
GNTKNHPMLMNLLKDNPAQDF

SEQ ID NO: 15 - protein, 16 aa, Artificial sequence
  synthetic amino acid sequence
SSKGVLWRMLAEPVSR

SEQ ID NO: 16 - protein, 15 aa, Artificial sequence
  synthetic amino acid sequence
SRTLQLDWGTLYWSR

SEQ ID NO: 17 - protein, 15 aa, Artificial sequence
  synthetic amino acid sequence
SSNHQSSRLIELLSR

SEQ ID NO: 18 - protein, 19 aa, Artificial sequence
  synthetic amino acid sequence
LKEKHKILHRLLQDSSSPV

SEQ ID NO: 19 - protein, 14 aa, Artificial sequence
  synthetic amino acid sequence
QAQQKSLLQQLLTE

SEQ ID NO: 20 - protein, 21 aa, Artificial sequence
  synthetic amino acid sequence
KYSQTSHKLVQLLTTTAEQQL

SEQ ID NO: 21 - protein, 21 aa, Artificial sequence
  synthetic amino acid sequence
SLTARHKILHRLLQEGSPSDI

SEQ ID NO: 22 - protein, 21 aa, Artificial sequence
  synthetic amino acid sequence
KESKDHQLLRYLLDKDEKDLR

SEQ ID NO: 23 - protein, 15 aa, Artificial sequence
  synthetic amino acid sequence
PQAQQKSLLQQLLTE

SEQ ID NO: 24 - protein, 15 aa, Artificial sequence
  synthetic amino acid sequence
PQAQQKSLRQQLLTE

SEQ ID NO: 25 - protein, 21 aa, Artificial sequence
  synthetic amino acid sequence
HDSKGQTKLLQLLTTKSDQME

SEQ ID NO: 26 - protein, 21 aa, Artificial sequence
  synthetic amino acid sequence
SLKEKHKILHRLLQDSSSPVD

SEQ ID NO: 27 - protein, 21 aa, Artificial sequence
  synthetic amino acid sequence
PKKKENALLRYLLDKDDTKDI

SEQ ID NO: 28 - protein, 21 aa, Artificial sequence
  synthetic amino acid sequence
LESKGHKKLLQLLTCSSDDRG

SEQ ID NO: 29 - protein, 21 aa, Artificial sequence
  synthetic amino acid sequence
LLQEKHRILHKLLQNGNSPAE

SEQ ID NO: 30 - protein, 21 aa, Artificial sequence
  synthetic amino acid sequence
KKKENNALLRYLLDRDDPSDA

SEQ ID NO: 31 - protein, 21 aa, Artificial sequence
  synthetic amino acid sequence
QEAEEPSLLKKLLLAPANTQL

SEQ ID NO: 32 - protein, 21 aa, Artificial sequence
  synthetic amino acid sequence
PEVDELSLLQKLLLATSYPTS

SEQ ID NO: 33 - protein, 21 aa, Artificial sequence
  synthetic amino acid sequence
VSPREGSSLHKLLTLSRTPPE

SEQ ID NO: 34 - protein, 21 aa, Artificial sequence
  synthetic amino acid sequence
SKVSQNPILTSLLQITGNGGS

SEQ ID NO: 35 - protein, 21 aa, Artificial sequence
  synthetic amino acid sequence
GNTKNHPMLMNLLKDNPAQDF

SEQ ID NO: 36 - protein, 21 aa, Artificial sequence
  synthetic amino acid sequence
DVTLTSPLLVNLLQSDISAGH

SEQ ID NO: 37 - protein, 21 aa, Artificial sequence
  synthetic amino acid sequence
AMREAPTSLSQLLDNSGAPNV

SEQ ID NO: 38 - protein, 21 aa, Artificial sequence
  synthetic amino acid sequence
DAASKHKQLSELLRGGSGSSI

SEQ ID NO: 39 - protein, 21 aa, Artificial sequence
  synthetic amino acid sequence
KRKLIQQQLVLLLHAHKCQRR

SEQ ID NO: 40 - protein, 21 aa, Artificial sequence
  synthetic amino acid sequence
DAASKHKQLSELLRSGSSPNL

SEQ ID NO: 41 - protein, 21 aa, Artificial sequence
  synthetic amino acid sequence
GHPPAIQSLINLLADNRYLTA

SEQ ID NO: 42 - protein, 21 aa, Artificial sequence
  synthetic amino acid sequence
TLQQQAQQLYSLLGQFNCLTH

SEQ ID NO: 43 - protein, 21 aa, Artificial sequence
  synthetic amino acid sequence
GSRETSEKFKLLFQSYNVNDW

SEQ ID NO: 44 - protein, 21 aa, Artificial sequence
  synthetic amino acid sequence
NANYPRSILTSLLLNSSQSST

SEQ ID NO: 45 - protein, 21 aa, Artificial sequence
  synthetic amino acid sequence
IPIEPDYKFSTLLMMLKDMHD

SEQ ID NO: 46 - protein, 21 aa, Artificial sequence
  synthetic amino acid sequence
ATPPPSPLLSELLKKGSLLPT

SEQ ID NO: 47 - protein, 21 aa, Artificial sequence
  synthetic amino acid sequence
VDGHERAMLKRLLRIDSKCLH

SEQ ID NO: 48 - protein, 21 aa, Artificial sequence
  synthetic amino acid sequence
HEDLDKVKLIEYYLTKNKEGP

SEQ ID NO: 49 - protein, 21 aa, Artificial sequence
  synthetic amino acid sequence
ESPEFCLGLQTLLSLKCCIDL

SEQ ID NO: 50 - protein, 21 aa, Artificial sequence
  synthetic amino acid sequence
AATTQNPVLSKLLMADQDSPL

SEQ ID NO: 51 - protein, 30 aa, Artificial sequence
  synthetic amino acid sequence
MGQVPRTHRLITLADHICQIITQDFARNQV

SEQ ID NO: 52 - protein, 14 aa, Artificial sequence
  synthetic amino acid sequence
NLGLEDIIRKALMG

SEQ ID NO: 53 - protein, 40 aa, Artificial sequence
  synthetic amino acid sequence
APGVKGHQRVVTLAQHISEVITQDTYRHHPQQLSAPLPAP

SEQ ID NO: 54 - protein, 14 aa, Artificial sequence
  synthetic amino acid sequence
NMGLEAIIRKALMG

SEQ ID NO: 55 - protein, 21 aa, Artificial sequence
  synthetic amino acid sequence
RLTKTNPILYYMLQKGGNSVA

SEQ ID NO: 56 - protein, 21 aa, Artificial sequence
  synthetic amino acid sequence
QDSIVLTYLEGLLMHQAAGGS

SEQ ID NO: 57 - protein, 21 aa, Artificial sequence
  synthetic amino acid sequence
KGKQDSTLLASLLQSFSSRLQ

SEQ ID NO: 58 - protein, 21 aa, Artificial sequence
  synthetic amino acid sequence
CYGVASSHLKTLLKKSKVKDQ

SEQ ID NO: 59 - protein, 21 aa, Artificial sequence
  synthetic amino acid sequence
KPSVACSQLALLLSSEAHLQQ

SEQ ID NO: 60 - protein, 21 aa, Artificial sequence
  synthetic amino acid sequence
KQAANNSLLLHLLKSQTIPKP

SEQ ID NO: 61 - protein, 21 aa, Artificial sequence
  synthetic amino acid sequence
NSHQKVTLLQLLLGHKNEENV

SEQ ID NO: 62 - protein, 21 aa, Artificial sequence
  synthetic amino acid sequence
NLLERRTVLQLLLGNPTKGRV

SEQ ID NO: 63 - protein, 21 aa, Artificial sequence
  synthetic amino acid sequence
FSFSKNGLLSRLLRQNQDSYL

SEQ ID NO: 64 - protein, 21 aa, Artificial sequence
  synthetic amino acid sequence
RESKSFNVLKQLLLSENCVRD

SEQ ID NO: 65 - protein, 21 aa, Artificial sequence
  synthetic amino acid sequence
ELNADDAILRELLDESQKVMV

SEQ ID NO: 66 - protein, 21 aa, Artificial sequence
  synthetic amino acid sequence
YENLPPAALRKLLRAEPERYR

SEQ ID NO: 67 - protein, 21 aa, Artificial sequence
  synthetic amino acid sequence
MAFAGDEVLVQLLSGDKAPEG

SEQ ID NO: 68 - protein, 21 aa, Artificial sequence
  synthetic amino acid sequence
SCCYLCIRLEGLLAPTASPRP

SEQ ID NO: 69 - protein, 21 aa, Artificial sequence
  synthetic amino acid sequence
PSNKSVDVLAGLLLRRMELKP

SEQ ID NO: 70 - protein, 984 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 71 - protein, 299 aa, Homo sapiens
EEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 72 - protein, 248 aa, Homo sapiens
SPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 73 - protein, 299 aa, Homo sapiens
EEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLLSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 74 - protein, 248 aa, Homo sapiens
SPVMVLENIEPEIVYAGYDSSKPDTAENLLSTLNRLAGKQMIQVVKWAKVLPGFKNLPLEDQITLIQYSWMCLLSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 75 - protein, 248 aa, Homo sapiens
SPVMVLENIEPEIVYAGYDSSKPDTAENLLSTLNRLAGKQMIQVVKWAKVLPGFKNLPLEDQITLIQYSWMSLLSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 76 - protein, 248 aa, Homo sapiens
SPVKILESIEPEIVYAGYDSSKPDTAEYLLSTLNRLAGKQMIQVVKWAKILPGFRNLPLEDQITLIQYSWMCLSSFALSWRSYKHTNSQFLYFAPDLIFDEERMRQSAMFELCQGMHQISLQFVRLQLSFEEYTIMKVLLLLSTVPKDGLKSQAAFEEMRANYIKELKKMVTKCPSNSGQSWQRFYQLTKLLDSMHDLVSDLLEFCFYTFRESQALKVEFPAMLVEIISDQLPKVESGNAKPLYFHRK

SEQ ID NO: 77 - protein, 248 aa, Homo sapiens
SPVMVLENIEPEIVYAGYDSSKPDTAENLLSTLNRLAGKQMIQVVKWAKVLPGFKNLPLEDQITLIQYSWMSLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 78 - protein, 248 aa, Homo sapiens; identical to SEQ ID NO: 77

SEQ ID NO: 79 - protein, 248 aa, Homo sapiens
SPVMVLENIEPEIVYAGYDSSKPDTAENLLSTLNRLAGKQMIQVVKWAKVLPGFKNLPLEDQITLIQYSWMCLLSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKAPNNSGQSWQRFYQLTKLLDSMHDLVSDLLEFCFYTFRESHALKVEFPAMLVEIISDQLPKVESGNAKPLYFHRK

SEQ ID NO: 80 - protein, 248 aa, Homo sapiens; identical to SEQ ID NO: 79

SEQ ID NO: 81 - protein, 248 aa, Homo sapiens
SPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKAPNNSGQSWQRFYQLTKLLDSMHDLVSDLLEFCFYTFRESHALKVEFPAMLVEIISDQLPKVESGNAKPLYFHRK

SEQ ID NO: 82 - protein, 248 aa, Homo sapiens
SAAVILENIEPEIVYAGYDNTQPDTAENLLSSLNQLAGKQMVQVVKWAKVIPGFRNLPLEDQITLIQYSWMCLSSFALSWRSYKHASSQFLYFAPDLIFNEERMRQSAMYDLCQGMQQISLEFSRLQLTFEEYTLMKVLLLLSTVPKDGLKCQAAFEEMRVNYIKELRKVLLKSPHNSGQSWQRYFQLTKLLDSMQDLVGDLLEFCFYTFRESQALKVEFPAMLVEIISDQLPKVESGIAKPLYFHRK

SEQ ID NO: 83 - protein, 248 aa, Homo sapiens
SICSVLELIEPEVVFAGYDNTQPDTTDHLLSSLNQLAGKQMIRVVKWAKVLPGFRGLPIEDQITLIQYSWMCLSSFSLSWRSYKHTNGQMLYFAPDLVFNEDRMQQSAMYDLCLGMRQVSQEFVRLQLTYQEFLSMKVLLLLSTVPKEGLKNQAAFEEMRVNYIKELRRSVGKAPTTLDRRGNRSSQLTKLLDAMHDLGGELLDFCFYTFRESQALKVEFPEMLVEIISDQIPKVESGNTHTLYFHKK

SEQ ID NO: 84 - protein, 329 aa, Homo sapiens
SICSILELIEPEEVYSGYDNTQPDTTDHLLSSLNRLAGKQMVRMVKWAKVLPGFRGLPIEDQITLIQYSWMCLSSFCLSWRSYKHTNGQMLYFAPDLIFNEERMRQSAMYDLCLGMRQVSQEFLRLQLSYDEFLSMKVLLLLSTGLGRLTLFGFHCSKQLPPSPPHMRTVPKEGLKNQAAFEEMRLNYIKELRRSVGKATNNSGQTWQRFFQLTKLLDAMHDVSTLCLPRHAAPLGRPHDTTGFPPSFQESPHLHTQSKKAAQTPCETASKYMCEYSKLVGNLLDFCFYTFRESQVLKVEFPEMLVEIISDQIPKVESGLTHTIYFHKK

SEQ ID NO: 85 - protein, 919 aa, Homo sapiens
MEVQLGLGRVYPRPPSKTYRGAFQNLFQSVREVIQNPGPRHPEAASAAPPGASLLLLQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 86 - protein, 301 aa, Homo sapiens
CYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 87 - protein, 230 aa, Homo sapiens
DNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 88 - protein, 301 aa, Homo sapiens
CYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFAFDLLIKSHMVSVDFPEMMAEIISVQVPKILSGKVKPIYFHTQ

SEQ ID NO: 89 - protein, 230 aa, Homo sapiens
DNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFAFDLLIKSHMVSVDFPEMMAEIISVQVPKILSGKVKPIYFHTQ

SEQ ID NO: 90 - protein, 301 aa, Homo sapiens
CYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQLTFDLLIKSHMVSVDFPEMMAEIISVQVPKILSGKVKPIYFHTQ

SEQ ID NO: 91 - protein, 230 aa, Homo sapiens
DNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQLTFDLLIKSHMVSVDFPEMMAEIISVQVPKILSGKVKPIYFHTQ

SEQ ID NO: 92 - protein, 301 aa, Homo sapiens
CYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQLAFDLLIKSHMVSVDFPEMMAEIISVQVPKILSGKVKPIYFHTQ

SEQ ID NO: 93 - protein, 230 aa, Homo sapiens
DNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQLAFDLLIKSHMVSVDFPEMMAEIISVQVPKILSGKVKPIYFHTQ

SEQ ID NO: 94 - protein, 933 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 95 - protein, 256 aa, Homo sapiens
GQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 96 - protein, 248 aa, Homo sapiens
PLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 97 - protein, 248 aa, Homo sapiens; identical to SEQ ID NO: 96

SEQ ID NO: 98 - protein, 248 aa, Homo sapiens
PMISVLRGIEPEVVYAGYDNTKPETPSSLLTSLNHLCERQLLCVVKWSKLLPGFRNLHIDDQITLIQYSWMSLMVFAMGWRSYKHVSGQMLYFAPDLILNEQRMKESSFYSLCLSMWQLPQEFVRLQVSQEEFLCMKALLLLNTIPLEGLRSQSQFDEMRTSYIRELVKAIGLRQKGVVANSQRFYQLTKLMDSMHDLVKQLHLFCLNTFLQSRALSVEFPEMMSEVIAAQLPKILAGMVKPLLFHKK

SEQ ID NO: 99 - protein, 248 aa, Homo sapiens
ELLQILQSIEPEVVYAGYDNTQPETPSALLSSLNQLCERQLVCVVKWSKSLPGFRNLHIDDQITLLQYSWMSLMVFALGWRSYQHVSGQMLYFAPDLILNEQRMKDSSFYTLCLSMWQLPQEFMKLQVTHEEFLCMKALLLLNTIPLEGLKSQTNFDEMRSNYIRELAKAISLRHKGVIASSQRFYQLTKLMDSMHELVKQLHLYCLNTFLQSRSLSVEFPEMMSEVISAQLPKILAGMVKPLVFHKK

SEQ ID NO: 100 - protein, 248 aa, Homo sapiens
QMISILENIEPQVVYSGYDNTQPEVPHLLLNSLNRLCERQLLWIVRWSKSLPGFRNLHINDQMTLIQYSWMGLMLFSLGWRTFQNVTPDYLYFAPDLVLSNDQLRRSPIYDLCLAMQFVPQEFANLQVTKEEFLCMKALMLLNTVPLEGLKSQTQFDEMRQNYICELSKAIQLKEKGVVASSQRFYHLTKLMDNMHEIVKKVNLYCLSTFIQADAMKVEFPEMMTEVIASQLPKVLAGMVKPLMFHHK

SEQ ID NO: 101 - protein, 248 aa, Homo sapiens; identical to SEQ ID NO: 96

SEQ ID NO: 102 - protein, 248 aa, Homo sapiens; identical to SEQ ID NO: 96

SEQ ID NO: 103 - protein, 248 aa, Homo sapiens; identical to SEQ ID NO: 96

SEQ ID NO: 104 - protein, 461 aa, Homo sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 105 - protein, 260 aa, Homo sapiens
EELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 106 - protein, 281 aa, Homo sapiens
DDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 107 - protein, 243 aa, Homo sapiens
PEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKVTDLRMIGACHASRFLHMKVECPTELFPPLFLEV

SEQ ID NO: 108 - protein, 243 aa, Homo sapiens
DEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEV

SEQ ID NO: 109 - protein, 243 aa, Homo sapiens; identical to SEQ ID NO: 108

SEQ ID NO: 110 - protein, 243 aa, Homo sapiens
DEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFRLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEV

SEQ ID NO: 111 - protein, 243 aa, Homo sapiens; identical to SEQ ID NO: 110

SEQ ID NO: 112 - protein, 241 aa, Homo sapiens
TCPKKVNRYYLNGSPKPGMPVPEAPRPPVVQNGVVREADSSGAMDDDMVDQDIFSHLAEVITPAIIKVVEFAKQIPGFTKLVPDDQVALLKNCCFEVMCLRAASRFDKQRRTITMFGGLTVTKEQVSQGGLGRLAEPLFEFAEGLSQLHLDDTEVALLAALLVVADRPGVQDQESIDRLQDIILTAYKNYITRQRPHQPVLWGKILMKVTDLRALSVAHAEQVKLVKMECTNDIPPLFLEM

SEQ ID NO: 113 - protein, 243 aa, Homo sapiens
AEEWELIHVVTEAHRSTNAQGSHWKQKRKFLPEDIGQSPMASMPDGDKVDLEAFSEFTKIITPAITRVVDFAKKLPMFSELPCEDQIILLKGCCMEIMSLRAAVRYDPESETLTLSGEMAVKREQLKNGGLGVVSDAIFDLGKSLSAFNLDDTEVALLQAVLLMSSDRTGLICVDKIEKCQETYLLAFEHYINYRKHNIPHFWPKLLMKVTDLRMIGACHASRFLHMKVECPTELFPPLFLEV

SEQ ID NO: 114 - protein, 243 aa, Homo sapiens
SEEWELIRIVTEAHRSTNAQGSHWKQRRKFLPEDIGQSPMASMPDGDKVDLEAFSEFTKIITPAITRVVDFAKKLPMFSELTCEDQIILLKGCCMEIMSLRAAVRYDPDSETLTLSGEMAVKREQLKNGGLGVVSDAIFDLGRSLAAFNLDDTEVALLQAVLLMSSDRTGLICTDKIEKCQETYLLAFEHYINHRKHNIPHFWPKLLMKVTDLRMIGACHASRFLHMKVECPTELFPPLFLEV

SEQ ID NO: 115 - protein, 280 aa, Homo sapiens
SDPSGLIPDPLLDSRATSSTFPQLLTCPILRPGFSRPADAPPDKIGQSPVAPTSDGDKVDLEAFSEFTKIITPAITRVVDFAKKLPMFSELPCEDQIILLKGCCMEIMSLRAAMRYDPESETLTLSGEMAVKREQLKNGGLGVVSDAIFDLGKSLAQFNLDDTEVALLQAVLLMSSGNRRRGRPRPSPAPGSTSSSSSSSSSSDRSGLTCTDKIEKCQETYLLAFEHYINYRKHNIPHFWPKLLMKVTDLRMIGACHASRFLHMKVECPNELFPPLFLEV

SEQ ID NO: 116 - protein, 231 aa, Homo sapiens
DHEEALIRAILVAHKQTSHMYRRESSSGEESEPDSKKQKLEDEKPLSEIMTPSIVKVVEFAKRIPGFTGLHHDDQILLLKTCCMEIMCLRVAQKFDPDSQKLILSNGLRVGKSDMDHGVLSELIEPIFDFAVSMSRLQLTETEMALLAAVLLIAGDRPGLKEAKLVETLQDSLLTAFQHFINESRPKTPVHWAKILMKITDLRTISARHAERIMCIKLDRPNEIPQIFLEM

SEQ ID NO: 117 - protein, 243 aa, Homo sapiens; identical to SEQ ID NO: 108

SEQ ID NO: 118 - protein, 252 aa, Homo sapiens
QEEWEMIRVVTEAHMATNAQGNHWKQKRKFLSAVGVKEAKPEDIGSAPIVNAPEGNKVDIEAFSQFTKIITPAITRVVDFAKKLPMFCELPCEDQIILLKGCCMEIMSLRAAVRYDPESDTLTLNGEMAVTRGQLKNGGLGVVSDAIFDLGVSLSSFNLDDSEVALLQAVILLSSDRPGLTSVERIERCQEEFLLAFEHYINYRKHKVAHFWPKLLMKVTDLRMIGACHASRFLHMKVECPTELFPPLFLEV

SEQ ID NO: 119 - protein, 595 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 120 - protein, 229 aa, Homo sapiens
SLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNV

SEQ ID NO: 121 - protein, 314 aa, Homo sapiens
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 122 - protein, 238 aa, Homo sapiens
LTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAH

SEQ ID NO: 123 - protein, 229 aa, Homo sapiens
SLALSLTADQMVSALLDAEPPILYSEYDPTRPFSEASMMGLLTNLAYRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNV

SEQ ID NO: 124 - protein, 314 aa, Homo sapiens
SAGDMRAANLWPSPLMIKRSKKNSLALSLTADQMVSALLDAEPPILYSEYDPTRPFSEASMMGLLTNLAYRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 125 - protein, 238 aa, Homo sapiens
LTADQMVSALLDAEPPILYSEYDPTRPFSEASMMGLLTNLAYRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAH

SEQ ID NO: 126 - protein, 238 aa, Homo sapiens
LTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAH

SEQ ID NO: 127 - protein, 236 aa, Homo sapiens
LSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAH

SEQ ID NO: 128 - protein, 227 aa, Homo sapiens
NPTVPLISHLVNIEPNPILTGYNPQCTPTEGYLMALVTDLANREIEGLVDWAARLPGYGMLPMDDQVNLIRTVWLDLLMLGLVWRSMEHRGEWLVFAPDLLMDRSLCRLSGMEYICTPMLEFARQFADLQVPQEVYVCLKALTLYTTAVSRLQDYRQVQRLQHEINEALAEACSSTFGFSPGNIARLMMIVSQVRQLSSLGVDHLNRLRGAETVSVEGLLREIVDEP

SEQ ID NO: 129 - protein, 238 aa, Homo sapiens
LSPEELISRIMEAEPPEIYLMKDMKKPFTEANVMMSLTNLADKELVHMISWAKKIPGFVELSLFDQVHLLECCWLEVLMLGLMWRSVNHPGKLIFSPDLCLSRDESSCVQGLVEIFDMLLAATSRFRELKLQREEYVCLKAMILLNSNMCLGSSEGGEDLQSRSKLLCLLDSVTDALVWAISKTGLSFQQRSTRLAHLLMLLSHIRHVSNKGMDHLHCMKMKKMVPLYDLLLEMLDAH

SEQ ID NO: 130 - protein, 238 aa, Homo sapiens
LTAEQMVSALLEAEPPIVYSEYDPNRPFNEASMMTLLTNLADRELVHMINWAKRVPGFVDLTLHDQVHLLECAWLEILMIGLVWRSMEHPGKLLFAPNLLLDRNQGKCVEGMVEIFDMLLATAARFRMMNLQGEEFVCLKSIILLNSGVYTFLSSTLKSLEERDYIHRVLDKITDTLIHLMAKSGLSLQQQHRRLAQLLLILSHIRHMSNKGMEHLYNMKCKNVVPLYDLLLEMLDAH

SEQ ID NO: 131 - protein, 238 aa, Homo sapiens
LTAEQLISALMEAEAPIVYSEHDSTKPLSEASMMTLLTNLADRELVHMINWAKRVPGFVDLTLHDQVHLLECAWLEILMVGLIWRSVEHPGKLSFAPNLLLDRNQGRCVEGLVEIFDMLVTTATRFRMMRLRGEEFICLKSIILLNSGVYTFLSSTLESLEDTDLIHIILDKIIDTLVHFMAKSGLSLQQQQRRLAQLLLILSHIRHMSNKGMEHLYSMKCKNVVPLYDLLLEMLDAH

SEQ ID NO: 132 - protein, 243 aa, Homo sapiens
QRLKALIDALDVKEGEHRGEENHPTGQQAGNWQEISNPELIESVSSLVDRELTGIICWGKKIPGYSKLSLNDQVLLMESTWLDLLILDLVWCSIRHKGEKLLLSGGVLVNRNTISNRRNNSSGDDMEVLEMCDQILSIATKFYEFDLQRREYLCLKAITLVHGSLKGLESDTQVRQLQDDLTDALMDVCSERHALGSRRPAKMLLLLSHLRQVSARASSHLGAVRNGLKVPLYDILLDILTDQ

SEQ ID NO: 133 - protein, 235 aa, Homo sapiens
LSSEQFLTCLLNAEPPNMTCHHDVSRPFTAERLMMLLTNLADRELVHMIGWAKKVPGFVQISLRDQVLLLESSWLEVLIMGLIWRSMSQPGKLVFASNLILDRDDGECVEGIFEIFDILLNIVQHFRELQVWMDEYVCLKAIILLNASMMVATSEKDGSRAKVQQLVEATTDTLVKCIARRSLATPEQFRRLSHLLTILSHIRHISNKGIQHMYSMKCKNLVPFYDLLLEMLDAH

SEQ ID NO: 134 - protein, 530 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 135 - protein, 243 aa, Homo sapiens
LDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRG

SEQ ID NO: 136 - protein, 238 aa, Homo sapiens; identical to SEQ ID NO: 126

SEQ ID NO: 137 - protein, 236 aa, Homo sapiens; identical to SEQ ID NO: 127

SEQ ID NO: 138 - protein, 227 aa, Homo sapiens; identical to SEQ ID NO: 128

SEQ ID NO: 139 - protein, 238 aa, Homo sapiens; identical to SEQ ID NO: 129

SEQ ID NO: 140 - protein, 238 aa, Homo sapiens; identical to SEQ ID NO: 130

SEQ ID NO: 141 - protein, 238 aa, Homo sapiens; identical to SEQ ID NO: 131

SEQ ID NO: 142 - protein, 243 aa, Homo sapiens; identical to SEQ ID NO: 132

SEQ ID NO: 143 - protein, 235 aa, Homo sapiens; identical to SEQ ID NO: 133

SEQ ID NO: 144 - protein, 475 aa, Homo sapiens
MVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 145 - protein, 302 aa, Homo sapiens
SHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 146 - protein, 295 aa, Homo sapiens
GRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 147 - protein, 271 aa, Homo sapiens
ESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 148 - protein, 247 aa, Homo sapiens
ADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQV

SEQ ID NO: 149 - protein, 268 aa, Homo sapiens
ADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDL

SEQ ID NO: 150 - protein, 268 aa, Homo sapiens
ADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDM

SEQ ID NO: 151 - protein, 268 aa, Homo sapiens
ADLRALAKHLYDSYIKSFPLTKAKARAILTGKTTDKSPFVIYDMNSLRMGEDQIKCKHASPLQEQNKEVAIRIFQRCQFRSVEAVQEITEFAKNIPGFVNLDLNDQVTLLKYGVHEIIYTLLASLMNKDGVLISDGQGFMTREFLKSLRKPFCDFMEPKFEFAVKFNALELDDSDLAIFIAVIILSGDRPGLLNVKPIEDIQDNLLQALELQLKLNHPESSQLFAKLLQKMTDLRQIVTEHVQLLQIIKKTETDMSLHPLLQEIYKDL

SEQ ID NO: 152 - protein, 302 aa, Homo sapiens
ADLRALARHLYEAYLKYFPLTKAKARAILSGKTGDNAPFVIHDIKSLMEGEQFINCRQMPIQEQQQASVLTATHGGLTEHHMGSDYGVWGTTSISGQEPQNALELRFFQSCQSRSAEAVREVTEFAKSIPGFTDLDLNDQVTLLKYGVIEVLIIMMSPLMNKDGTLISYGQIFMTREFLKSLRKPFCQMMEPKFEFSVKFNTLELDDSDMALFLVVIILSGDRPGLLNVKPIEQLQETVLHSLELQLKLNHPDSLQLFAKLLQKMTDLRQIVTDHVHLIQLLKKTEVDMCLHPLLQEIMKDL

SEQ ID NO: 153 - protein, 242 aa, Homo sapiens
TKLVSPCDEMLTPDLKARLLFASQVFKKNIGKDKPTIYKNVIGSKIVQILYSDFQARVVNGICELTEFAKRLPNFHDISLQDQVILLKYGSYETMFVLFSRLIYGEGMILPKSNIYVTFNFVYQLGVAGDIMKSKFLFAKKMLALELTDDEMALFVAMIILCPDRPEINDRKLVERIQEKVLFALEYQLSISHPHKPRLFAHLLLKMAELRELVSKHVVMVQKLADAKDFVPPLLCEIMQDM

SEQ ID NO: 154 - protein, 267 aa, Homo sapiens
SDLDVLSQLIHSSYMNTFTMTKKRARDILTGRNSISPFVIHDMDTLWQAEQGTVWEQLPTQNLTGTEIGVHVFYRCQCTSVETVRALTDFAKRIPGFGTLYLNDQVTLLKYGVHEAIFCMLASLMNKDGLLVAGGRGFVTREFLRSLRQPFCHIMEPKFHFASKFNALELNDSDLALFVASIILCGDRPGLINPSQVEDIQEGILGALRRHLKASHTDAPFLFPKLLHKMADLRQLVTEHAELVQSIKRTESSAALHPLLQEIYRDM

SEQ ID NO: 155 - protein, 242 aa, Homo sapiens
RIHSIYINMWMGQFISMPVGSRATRSKEPNGKTEDHKSMKELTEKEALTKFCRGALLAIIESLAKFAKKLQEFKNLDLNDQVCLLKHAAFEVALIATSSRYASEGLWFPTDGVYFTKKMLEQLEISFFDGKFKFFEKMKKLNLTERELALFCVLSLTSPDRDELIERDEVEKFQEQVLEAIQIELRTNHSNHRMLLPRLLSLLVDLRQLVLDHIKQVQQLMLMDDPSYSGPPPLIKEIFGLY

SEQ ID NO: 156 - protein, 260 aa, Homo sapiens
VDSIAQQFNDIVCAMTQEDLEKFWKRCSRPFTAHMPSGTYVIEGMQLNKDGPPQEITSRAEMAQQCFVSMEVTIEKFATFAKQLPEFRRLSSSDQLTLFKGAALEVCATLSASRYYHGVYRFPEINTYIRRDVAENSPFGKVTTYTTEMMFYEMFNELGLTDKEKAVFCTFLLYSPDREGLVDREVVERHQEHLAQILYLEVKKNHPDRSNLYAKLMDVAVALRTLVPDHLARLEQIKMRCNGHLPAEPSPLLNEVYGSI

SEQ ID NO: 157 - protein, 341 aa, Homo sapiens
SDLRSLARLVQEAYLRIFPLSKAKAQAILAGKVQNNAVVIHDHESLAQAEDTILQKSGYGTIHNHGSIGVNIASVGGGCGGARGGTICDGRGGPCDSTTRGRVLGTDCVFITANSVTDTELAADAEGNRSSDQEVTPPRGAAEIRIFNRCHYRLVEAVREVTEFAKSIPGFMILDLNDQVTLLKYGVYEVIFAMLAAQINKDGLLIAYGSAFITREFLRSLRSPFCHIMEPKFEFSIRFNALSLDGTDLALYMAAIILCGDRPGLINVNPVERIQDRILQALDLQLRKTHPESPFLFPKLLQKLSDLRQLVTEHAQMVHNIRKTEADTALPPLLQEIFKDM

SEQ ID NO: 158 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 159 - protein, 247 aa, Homo sapiens
TLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 160 - protein, 247 aa, Homo sapiens
TLVSLLEVIEPEVLYAGYDSSVPDSTWRIMTTLNMLGGRQVIAAVKWAKAIPGFRNLHLDDQMTLLQYSWMSLMAFALGWRSYRQSSANLLCFAPDLIINEQRMTLPDMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 161 - protein, 247 aa, Homo sapiens
TLVSLLEVIEPEVLYSGYDSTLPDSSWRIMSTLNMLGGRQVVAAVKWAKAIPGFRNLHLDDQMTLLQYSWMFLMAFALGWRSYKQSNGNLLCFAPDLIINEQRMNLPCMYEQCKHMLMVARELSRLQVSYEEYLCMKTLLLLSTIPKEGLKSQTLFEEIRMTYIKELGKAIVKREGNSSQNWQRFYQLTKLLDSMHDVVENLLSFCFQTFLDKSMSIEFPEMLAEIISNQIPKYSNGNIKKLLFHQK

SEQ ID NO: 162 - protein, 247 aa, Homo sapiens
TLISLLEVIEPEVLYSGYDSSIPDTTRRLMSSLNMLGGRQVVSAVRWAKAIPGFRNLHLDDQMTLLQYSWMFLMVFALGWRSYKQTNGSILYFAPDLVITEDRMHLPFMQERCQEMLKIAGEMSSLQISYDEYLCMKVLLLMCTIPKEGLKSHALFEEIRMTYIKELGKAIVKREGNSSQNWQRFYQLTKLLDSMHEVAENLLAFCFLSFLDKSMSIEFPDMLSEIISNQIPKYSSGNLKKLLFHQK

SEQ ID NO: 163 - protein, 247 aa, Homo sapiens
TMLSVLKAIEPETIYSGYDSTLPDTSSRLMSTLNRLGGQQVVSAVKWAKSLPGFRNLHLDDQMILLQCSWLFLMSFSLGWRSYQQCNGSMLCFAPDLVINEERMRLPFMNDQCEKMLRICREFVRLQLSHEEYLCMKVLLLLSTVPKDGLKSQAVFDEIRMTYIKELGKAIVKREENPSQNWQRFYQLTKLLDSMQEMVEGLIKFCFYTFVNKTLSVEFPEMLVEIITNQIPKFQEGGIKALLFHQK

SEQ ID NO: 164 - protein, 247 aa, Homo sapiens
TLVSLLEVIEPEVLYAGYDSSVPDSTWRIMTTLNMLGGRQVIAAVKWAKAIPGFRNLHLDDQMTLLQYSWMYLMAFALGWRSYRQSSANLLCFAPDLIINEQRMTLPGMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 165 - protein, 247 aa, Homo sapiens
TLVSLLEVIEPEVLYAGYDSSVPDSTWRIMTTLNMLGGRQVIAAVKWAKAIPGFRNLHLDDQMTLLQYSWMSLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 166 - protein, 247 aa, Homo sapiens; identical to SEQ ID NO: 165

SEQ ID NO: 167 - protein, 427 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 168 - protein, 305 aa, Homo sapiens
ELSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 169 - protein, 297 aa, Homo sapiens
LSDEQMQIINSLVEAHHKTYDDSYSDFVRFRPPVREGPVTRSASRAASLHSLSDASSDSFNHSPESVDTKLNFSNLLMMYQDSGSPDSSEEDQQSRLSMLPHLADLVSYSIQKVIGFAKMIPGFRDLTAEDQIALLKSSAIEIIMLRSNQSFSLEDMSWSCGGPDFKYCINDVTKAGHTLELLEPLVKFQVGLKKLKLHEEEHVLLMAICLLSPDRPGVQDHVRIEALQDRLCDVLQAYIRIQHPGGRLLYAKMIQKLADLRSLNEEHSKQYRSLSFQPEHSMQLTPLVLEVFGSEV

SEQ ID NO: 170 - protein, 252 aa, Homo sapiens
LSEEQQRIIAILLDAHHKTYDPTYSDFCQFRPPVRVNDGGGSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEI

SEQ ID NO: 171 - protein, 297 aa, Homo sapiens
ISDEQQKMIDILLEAHRKTFDTTYSDFNKFRPPVRENVDPFRRITRSSSVHTQGSPSEDSDVFTSSPDSSEHGFFSASLFGQFEYSSMGGKSGELSMLPHIADLVSYSIQKIIGFAKMIPGFRDLIAEDQIALLKSSVIEVIMLRSNQSFSLDDMSWTCGSEDFKYKVDDVTQAGHNMELLEPLVKFQVGLKKLDLHEEEHVLLMAICILSPDRPGLQDKALVESIQDRLSSTLQTYILCKHPPPGSRLLYAKMIQKLADLRSLNEEHSKQYRSISFLPEHSMKLTPLMLEVFSDEI

SEQ ID NO: 172 - protein, 304 aa, Homo sapiens
LSEEQQKVIDTLLEAHHKTFDTTYSDFNKFRPPVRSKFSSRMATHSSSVVSQDFSSEDSNDVFGSDAFAAFPEPMEPQMFSNLDLSEESDESPSMNIELPHLPMLPHLADLVSYSIQKVIGFAKMIPGFRDLTAEDQIALLKSSAIEVIMLRSNQSFTMEDMSWTCGSNDFKYKVSDVTQAGHSMDLLEPLVKFQVGLKKLNLHEEEHVLLMAICILSPDRPGVQDTSLVESIQDRLSDILQTYIRCRHPPPGSRLLYAKMIQKLADLRSLNEEHSKQYRCLSFQPEHSMQLTPLVLEVFGNEI

SEQ ID NO: 173 - protein, 410 aa, Homo sapiens [sequence omitted]

SEQ ID NO: 174 - protein, 243 aa, Homo sapiens
PEEWDLIHIATEAHRSTNAQGSHWKQRRKFLPDDIGQSPIVSMPDGDKVDLEAFSEFTKIITPAITRVVDFAKKLPTFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKQLMKVTDLRMIGACHASRFLHMKVECPTELFPPLFLEV

SEQ ID NO: 175 - protein, 243 aa, Homo sapiens; identical to SEQ ID NO: 108

SEQ ID NO: 176 - protein, 243 aa, Homo sapiens; identical to SEQ ID NO: 108

SEQ ID NO: 177 - protein, 243 aa, Homo sapiens; identical to SEQ ID NO: 110

SEQ ID NO: 178 - protein, 243 aa, Homo sapiens; identical to SEQ ID NO: 110

SEQ ID NO: 179 - protein, 241 aa, Homo sapiens; identical to SEQ ID NO: 112

SEQ ID NO: 180 - protein, 243 aa, Homo sapiens; identical to SEQ ID NO: 113

SEQ ID NO: 181 - protein, 243 aa, Homo sapiens; identical to SEQ ID NO: 114

SEQ ID NO: 182 - protein, 280 aa, Homo sapiens; identical to SEQ ID NO: 115

SEQ ID NO: 183 - protein, 231 aa, Homo sapiens; identical to SEQ ID NO: 116

SEQ ID NO: 184 - protein, 243 aa, Homo sapiens; identical to SEQ ID NO: 108

SEQ ID NO: 185 - protein, 252 aa, Homo sapiens; identical to SEQ ID NO: 118

SEQ ID NO: 186 - protein, 448 aa, Homo sapiens
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 187 - protein, 231 aa, Homo sapiens
DLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLEN

SEQ ID NO: 188 - protein, 231 aa, Homo sapiens; identical to SEQ ID NO: 187

SEQ ID NO: 189 - protein, 235 aa, Homo sapiens
ALVTSVHKFHVETFPLSSELKKYQIPSPPIVKDTSAKTDSNLWEKFAELSTKCIVKIVEFAKGIPGFQDFTIADQITLLKCACLEVLFLRICSRFSPEHDTMTFSDGLTLTRKQMRVCGFGPITEQVFSFAQSLHPLNADATEIGLLSAICLVSADRVDLEEPDKVELLQESLVEGLKYYARKRRPHTPQVFPKLIIKISDLRSISLKGADRVVTVKTEIPCGAMPPLMSEMLEN

SEQ ID NO: 190 - protein, 231 aa, Homo sapiens
DLTEKIRKAHQETFPSLCQLGKYTTNSSADHRVRLDLGLWDKFSELATKCIIKIVEFAKRLPGFTSLTIADQITLLKAACLDILILRICTRYTPEQDTMTFSDGLTLNRTQMHNAGFGPLTDLVFTFANQLLPLEMDDTETGLLSAICLICGDRQDLEEPMKVDKLQEPLLEALKIYIRKRRPNKPHMFPKILMKITDLRSISAKGAERVITLKMEIPGSMPPLIQEMLEN

SEQ ID NO: 191 - protein, 231 aa, Homo sapiens
ELIQKVSKAHQETFPSLCQLGKYTTNSSADQRVQLDLGLWDKFSELSTKCIIKIVEFAKRLPGFTTLTIADQITLLKSACLDILMLRICTRYTPEQDTMTFSDGLTLNRTQMHNAGFGPLTDLVFSFADQLLPLEMDDTETGLLSAICLICGDRMDLEEPEKVEKLQEPLLEALKFYARRRRPDKPYMFPRMLMKITDLRGISTKGAERAITLKLEIPGPMPPLIREMLEN

SEQ ID NO: 192 - protein, 231 aa, Homo sapiens
ELVNKVSKAHQETFPSLCQLGKYTTNSSSDHRIQLDLGLWDKFSELSTKCIIKIVEFAKRLPGFTTLTIADQITLLKSACLDILMLRICTRYTPEQDTMTFSDGLTLNRTQMHNAGFGPLTDLVFAFAGQLLPLEMDDTETGLLSAICLICGDRMDLEEPERVDRLQEPLLEALKIYARRRRPNKPHMFPRMLMKITDLRGISTKGAERAITLKMEIPGPMPPLIREMLEN

SEQ ID NO: 193 - protein, 229 aa, Homo sapiens
DILQEVLRAHRDTFPQRPLHPIHNAVSAGNIDIDMVMFDYVTDMSSRAIVMVVDFAKKLPGFLSLSTQDQITLLKASCLDIMILRICSRFNPQDASVTFTTGLTLTQGQLKAGGFGSLLDVIFTFASSLSRMHIDETEIALLSAICLISEDRTGLEDAPRIEKMQEPLLEGLRLYVRKRRPKESHFFAKLLMKITDLRCISVKSAEKVFDMKVEFVKEMPALISEMIDK

SEQ ID NO: 194 - protein, 231 aa, Homo sapiens
TIITTVREAHMATLPDMGKLPKYKVKNAAEQRGPTDIELWQHFSDLCTETIIKIVQFAKKVPGFTTFGTADQITLLKAACLDILILRLATRLDKESDTVTFINGMMLSRTQMHNAGFGPLTDGVFTFAEGMQKLLFDETEIGLMCSICLVCGDRQGLEDIQRAENLQEPLLEALKAYSRRRIPDDPQRFPKMIMKITDLRSISSKGAERVITLKMELSSPMPPLIAEIWEK

SEQ ID NO: 195 - protein, 231 aa, Homo sapiens; identical to SEQ ID NO: 187

SEQ ID NO: 196 - protein, 231 aa, Homo sapiens
ELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLEN

SEQ ID NO: 197 - protein, 512 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 198 - protein, 183 aa, Homo sapiens
YQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIE

SEQ ID NO: 199 - protein, 119 aa, Homo sapiens
DNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 200 - protein, 1055 aa, Homo sapiens
MAAAYLDPNLNHTPSSSTKTHLGTGTERSPGAMERVLKVFHYFESSNEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQDIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFNQVQTIQYSNSEDKDRKGMLQLKIAGAPEPLTVTAPSLTIAENMADLIDGYCRLVNGATQSFIIRPQKEGERALPSIPKLANNEKQGMRTHAVSVSETDDYAEIIDEEDTYTMPSTRDYEIQRERIELGRCIGEGQFGDVHQGVYLSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKVQQEERMRMESRRQATVSWDSGGSDEAPPKPSRPGYPSPRSSEGFYPSPQHMVQTNHYQISGYPGSHGIPAMAGSIYPGQASLLDQTELWNHRPQEMSMWQPSVEDSAALDLRGMGQVLPPHLMEERLIRQQQEMEEDQRWLEKEERFLKPDVRLSRGSIDREDGSFQGPTGNQHIYQPVGKPDPAAPPKKPPRPGAPGHLSNLSSISSPAESYNEGVKPWRLQPQEISPPPTANLDRSNDKVYENVTGLVKAVIEMSSKIQPAPPEEYVPMVKEVGLALRTLLATVDETIPILPASTHREIEMAQKLLNSDLGELISKMKLAQQYVMTSLQQEYKKQMLTAAHALAVDAKNLLDVIDQARLKMLGQTRPH

SEQ ID NO: 201 - protein, 472 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 202 - protein, 236 aa, Homo sapiens
KSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 203 - protein, 447 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 204 - protein, 266 aa, Homo sapiens
QEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 205 - protein, 497 aa, Homo sapiens
MRTQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 206 - protein, 261 aa, Homo sapiens
STPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 207 - protein, 462 aa, Homo sapiens
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 208 - protein, 238 aa, Homo sapiens
SANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 209 - protein, 434 aa, Homo sapiens
MEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 210 - protein, 305 aa, Homo sapiens
SERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 211 - protein, 19 aa, Artificial sequence
  synthetic amino acid sequence
RCRERRRNERLRRESVRPV

SEQ ID NO: 212 - protein, 29 aa, Artificial sequence
  synthetic amino acid sequence
RKGRMMDVKKCGIQDTNSKKQSDTHLEET

SEQ ID NO: 213 - protein, 32 aa, Artificial sequence
  synthetic amino acid sequence
KKRHMASYSMCSDPSTRDPPGRPEPYVEVYLI

SEQ ID NO: 214 - protein, 35 aa, Artificial sequence
  synthetic amino acid sequence
TKKKYSSSVHDPNGEYMFMRAVNTAKKSRLTDVTL

SEQ ID NO: 215 - protein, 35 aa, Artificial sequence
  synthetic amino acid sequence
MEESVVRPSVFVVDGQTDIPFTRLGRSHRRQSCSV

SEQ ID NO: 216 - protein, 39 aa, Artificial sequence
  synthetic amino acid sequence
SLSKMLKKRSPLTTGVYVKMPPTEPECEKQFQPYFIPIN

SEQ ID NO: 217 - protein, 40 aa, Artificial sequence
  synthetic amino acid sequence
ARTQIKKLCSWRDKNSAACVVYEDMSHSRCNTLSSPNQYQ

SEQ ID NO: 218 - protein, 42 aa, Artificial sequence
  synthetic amino acid sequence
KRGRKKLLYIFKQPFMRPVQTTQEEDGCSCRFPEEEEGGCEL

SEQ ID NO: 219 - protein, 43 aa, Artificial sequence
  synthetic amino acid sequence
WVRSKRSRLLHSDYMNMTPRRPGPTRKHYQPYAPPRDFAAYRS

SEQ ID NO: 220 - protein, 49 aa, Artificial sequence
  synthetic amino acid sequence
HQRRKYRSNKGESPVEPAEPCHYSCPREEEGSTIPIQEDYRKPEPACSP

SEQ ID NO: 221 - protein, 51 aa, Artificial sequence
  synthetic amino acid sequence
RRQWRPRRFSALEQGIHPPQAQSKIEELEQEPEPEPEPEPEPEPEPEPEQL

SEQ ID NO: 222 - protein, 54 aa, Artificial sequence
  synthetic amino acid sequence
HIWQLRSQCMWPRETQLLLEVPPSTEDARSCQFPEEERGERSAEEKGRLGDLWV

SEQ ID NO: 223 - protein, 61 aa, Artificial sequence
  synthetic amino acid sequence
NRRRRRERRDLFTESWDTQKAPNNYRSPISTSQPTNQSMDDTREDIYVNYPTFSRRPKTRV

SEQ ID NO: 224 - protein, 62 aa, Artificial sequence
  synthetic amino acid sequence
KKVAKKPTNKAPHPKQEPQEINFPDDLPGSNTAAPVQETLHGCQPVTQEDGKESRISVQERQ

SEQ ID NO: 225 - protein, 77 aa, Artificial sequence
  synthetic amino acid sequence
KWYSHSKEKIQNLSLISLANLPPSGLANAVAEGIRSEENIYTIEENVYEVEEPNEYYCYVSSRQQPSQPLGCRFAMP

SEQ ID NO: 226 - protein, 80 aa, Artificial sequence
  synthetic amino acid sequence
RKKKALRIHSVEGDLRRKSAGQEEWSPSAPSPPGSCVQAEAAPAGLCGEQRGEDCAELHDYFNVLSYRSLGNCSFFTETG

SEQ ID NO: 227 - protein, 83 aa, Artificial sequence
  synthetic amino acid sequence
KLRKAHVIWKKENEVSEHTLESYRSRSNNEETSSEEKNGQSSHPMRCMNYITKLYSEAKTKRKENVQHSKLEEKHIQVPESIV

SEQ ID NO: 228 - protein, 98 aa, Artificial sequence
  synthetic amino acid sequence
ICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 229 - protein, 101 aa, Artificial sequence
  synthetic amino acid sequence
HRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 230 - protein, 107 aa, Artificial sequence
  synthetic amino acid sequence
CCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 231 - protein, 114 aa, Artificial sequence
  synthetic amino acid sequence
CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 232 - protein, 117 aa, Artificial sequence
  synthetic amino acid sequence
TKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 233 - protein, 120 aa, Artificial sequence
  synthetic amino acid sequence
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 234 - protein, 187 aa, Artificial sequence
  synthetic amino acid sequence
RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 235 - protein, 108 aa, Artificial sequence
  synthetic amino acid sequence
TYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQ

SEQ ID NO: 236 - protein, 42 aa, Artificial sequence
  synthetic amino acid sequence
ALYLLRRDQRLPPDAHKPPGGGSFRTPIQEEQADAHSTLAKI

SEQ ID NO: 237 - protein, 51 aa, Artificial sequence
  synthetic amino acid sequence
MGWIRGRRSRHSWEMSEFHNYNLDLKKSDFSTRWQKQRCPVVKSKCRENAS

SEQ ID NO: 238 - protein, 48 aa, Artificial sequence
  synthetic amino acid sequence
KKYFFKKEVQQLSVSFSSLQIKALQNAVEKEVQAEDNIYIENSLYATD

SEQ ID NO: 239 - protein, 22 aa, Artificial sequence
  synthetic amino acid sequence
SGFLQEKVWVMLVTSLVALQAL

SEQ ID NO: 240 - protein, 85 aa, Artificial sequence
  synthetic amino acid sequence
SWRRRQRRLRGASSAEAPDGDKDAPEPLDKVIILSPGISDATAPAWPPPGEDPGTTPPGHSVPVPATELGSTELVTTKTAGPEQQ

SEQ ID NO: 241 - protein, 111 aa, Artificial sequence
  synthetic amino acid sequence
ACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 242 - protein, 95 aa, Artificial sequence
  synthetic amino acid sequence
MAEAITYADLRFVKAPLKKSISSRLGQDPGADDDGEITYENVQVPAVLGVPSSLASSVLGDKAAVKSEQPTASWRAVTSPAVGRILPCRTTCLRY

SEQ ID NO: 243 - protein, 141 aa, Artificial sequence
  synthetic amino acid sequence
KLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 244 - protein, 45 aa, Artificial sequence
  synthetic amino acid sequence
RKWCQYQKEIMERPPPFKPPPPPIKYTCIQEPNESDLPYHEMETL

SEQ ID NO: 245 - protein, 84 aa, Artificial sequence
  synthetic amino acid sequence
LRKRRDSLSLSTQRTQGPAESARNLEYVSVSPTNNTVYASVTHSNRETEIWTPRENDTITIYSTINHSKESKPTFSRATALDNV

SEQ ID NO: 246 - protein, 88 aa, Artificial sequence
  synthetic amino acid sequence
WFLKRERQEEYIEEKKRVDICRETPNICPHSGENTEYDTIPHTNRTILKEDPANTVYSTVEIPKKMENPHSLLTMPDTPRLFAYENVI

SEQ ID NO: 247 - protein, 82 aa, Artificial sequence
  synthetic amino acid sequence
KTHRRKAARTAVGRNDTHPTTGSASPKHQKKSKLHGPTETSSCSGAAPTVEMDEELHYASLNFHGMNPSKDTSTEYSEVRTQ

SEQ ID NO: 248 - protein, 38 aa, Artificial sequence
  synthetic amino acid sequence
MTDSVIYSMLELPTATQAQNDYGPQQKSSSSRPSCSCL

SEQ ID NO: 249 - protein, 45 aa, Artificial sequence
  synthetic amino acid sequence
MDQQAIYAELNLPTDSGPESSSPSSLPRDVCQGSPWHQFALKLSC

SEQ ID NO: 250 - protein, 168 aa, Artificial sequence
  synthetic amino acid sequence
LRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 251 - protein, 83 aa, Artificial sequence
  synthetic amino acid sequence
RWCSNKKNAAVMDQESAGNRTANSEDSDEQDPQEVTYTQLNHCVFTQRKITRPSQRPKTPPTDIIVYTELPNAESRSKVVSCP

SEQ ID NO: 252 - protein, 84 aa, Artificial sequence
  synthetic amino acid sequence
HLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 253 - protein, 10 aa, Artificial sequence
  synthetic amino acid sequence
MAVFKTTLWR

SEQ ID NO: 254 - protein, 29 aa, Artificial sequence
  synthetic amino acid sequence
KGSQRVPEEPGEQPIYMNFSEPLTKDMAT

SEQ ID NO: 255 - protein, 11 aa, Artificial sequence
  synthetic amino acid sequence
VNRPQWAPPGR

SEQ ID NO: 256 - protein, 8 aa, Artificial sequence
  synthetic amino acid sequence
VTLRSFVP

SEQ ID NO: 257 - protein, 35 aa, Artificial sequence
  synthetic amino acid sequence
AAWHGQKPGTHPPSELDCGHDPGYQLQTLPGLRDT

SEQ ID NO: 258 - protein, 32 aa, Artificial sequence
  synthetic amino acid sequence
QHSQRSPPRCSQEANSRKDNAPFRVVEPWEQI

SEQ ID NO: 259 - protein, 168 aa, Artificial sequence
  synthetic amino acid sequence
QHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 260 - protein, 116 aa, Artificial sequence
  synthetic amino acid sequence
LRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 261 - protein, 128 aa, Artificial sequence
  synthetic amino acid sequence
MAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 262 - protein, 61 aa, Artificial sequence
  synthetic amino acid sequence
KVNGCRKYKLNKTESTPVVEEDEMQPYASYTEKNNPLYDTTNKVKASEALQSEVDTDLHTL

SEQ ID NO: 263 - protein, 98 aa, Artificial sequence
  synthetic amino acid sequence
RMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 264 - protein, 113 aa, Artificial sequence
  synthetic amino acid sequence
WRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 265 - protein, 37 aa, Artificial sequence
  synthetic amino acid sequence
MSDSKEPRLQQLGLLEEEQLRGLGFRQTRGYKSLAGC

SEQ ID NO: 266 - protein, 29 aa, Artificial sequence
  synthetic amino acid sequence
RKSSGGKGGSYSQAACSDSAQGSDVSLTA

SEQ ID NO: 267 - protein, 95 aa, Artificial sequence
  synthetic amino acid sequence
LPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 268 - protein, 178 aa, Artificial sequence
  synthetic amino acid sequence
RRRHRGKFRKDVQKEKDLQLSSGAEEPITRKGELQKRPNPAAATQEESLYASVEDMQTEDGVELNSWTPPEEDPQGETYAQVKPSRLRKAGHVSPSVMSREQLNTEYEQAEEGQGANNQAAESGESQDVTYAQLCSRTLRQGAAASPLSQAGEAPEEPSVYATLAAARPEAVPKDMEQ

SEQ ID NO: 269 - protein, 42 aa, Artificial sequence
  synthetic amino acid sequence
SAGSAGSAGSAGSAGSAGSAGSAGSAGSAGSAGSAGSAGSAG

SEQ ID NO: 270 - protein, 42 aa, Artificial sequence; identical to SEQ ID NO: 218
  synthetic amino acid sequence

SEQ ID NO: 271 - protein, 42 aa, Artificial sequence; identical to SEQ ID NO: 218
  synthetic amino acid sequence

SEQ ID NO: 272 - protein, 42 aa, Artificial sequence; identical to SEQ ID NO: 218
  synthetic amino acid sequence

SEQ ID NO: 273 - protein, 93 aa, Artificial sequence
  synthetic amino acid sequence
KKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 274 - protein, 118 aa, Artificial sequence
  synthetic amino acid sequence
KCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 275 - protein, 74 aa, Artificial sequence
  synthetic amino acid sequence
HFGKTGRASDQRDLTEHKPSVSNHTQDHSNDPPNKMNEVTYSTLNFEAQQPTQPTSASPSLTATEIIYSEVKKQ

SEQ ID NO: 276 - protein, 112 aa, Artificial sequence
  synthetic amino acid sequence
DVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICG

SEQ ID NO: 277 - protein, 116 aa, Artificial sequence
  synthetic amino acid sequence
AVMEGPLFLQSQRFGTKRWRKTWAVLYPASPHGVARLEFFDHKGSSSGGGRGSSRRLDCKVIRLAECVSVAPVTVETPPEPGATAFRLDTAQRSHLLAADAPSSAAWVQTLCRNAF

SEQ ID NO: 278 - protein, 111 aa, Artificial sequence
  synthetic amino acid sequence
GAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAF

SEQ ID NO: 279 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNSLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 280 - protein, 1441 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 281 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 282 - protein, 1420 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 283 - protein, 798 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 284 - protein, 1023 aa, Homo sapiens
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLLQKLLLATSYPTSSSDTQKEGTAWRQAGLRSKSQRPCVKADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 285 - protein, 1664 aa, Homo sapiens
MAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 286 - protein, 1581 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTPTNTFPGGPITTLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 287 - protein, 2063 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 288 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 289 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 290 - protein, 579 aa, Homo sapiens
MNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 291 - protein, 614 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 292 - protein, 1016 aa, Homo sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 293 - protein, 2696 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 294 - protein, 951 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 295 - protein, 513 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 296 - protein, 942 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSDLPQDLCPLYRPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 297 - protein, 281 aa, Homo sapiens
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 298 - protein, 433 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMRSEGPDVSVKIELDPQGEAAQSANESKNE

SEQ ID NO: 299 - protein, 2440 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 300 - protein, 2514 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 301 - protein, 1158 aa, Homo sapiens
MTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 302 - protein, 2080 aa, Homo sapiens
MSSSPSRSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGSPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 303 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 304 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 305 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 306 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 307 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 308 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 309 - protein, 521 aa, Homo sapiens
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 310 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 311 - protein, 231 aa, Homo sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 312 - protein, 538 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 313 - protein, 259 aa, Homo sapiens
MVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 314 - protein, 300 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 315 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 316 - protein, 400 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 317 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 318 - protein, 896 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 319 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 320 - protein, 857 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 321 - protein, 422 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 322 - protein, 636 aa, Homo sapiens
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 323 - protein, 745 aa, Homo sapiens
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 324 - protein, 372 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 325 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 326 - protein, 342 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH

SEQ ID NO: 327 - protein, 660 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCDR

SEQ ID NO: 328 - protein, 659 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKRRHSCPWTGS

SEQ ID NO: 329 - protein, 629 aa, Homo sapiens
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 330 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 331 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 332 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 333 - protein, 622 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 334 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 335 - protein, 557 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 336 - protein, 331 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 337 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 338 - protein, 337 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 339 - protein, 263 aa, Homo sapiens
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 340 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 341 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 342 - protein, 504 aa, Homo sapiens
MKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 343 - protein, 311 aa, Homo sapiens
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 344 - protein, 574 aa, Homo sapiens
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSYRYVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES

SEQ ID NO: 345 - protein, 520 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 346 - protein, 832 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 347 - protein, 502 aa, Homo sapiens
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 348 - protein, 707 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 349 - protein, 595 aa, Homo sapiens
MESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 350 - protein, 533 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHASLSSPGGEDAWLIGVGGSVPSGVAVRCPVCLEAPLVSGCLLQTPGALDPGTAGPPHPTGCCSGPHLPAPTVRPGPSAASAPPARGGLGGAAAPGGSAG

SEQ ID NO: 351 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 352 - protein, 296 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQ

SEQ ID NO: 353 - protein, 211 aa, Homo sapiens
MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 354 - protein, 575 aa, Homo sapiens
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 355 - protein, 385 aa, Homo sapiens
MNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKDMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 356 - protein, 570 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 357 - protein, 599 aa, Homo sapiens
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 358 - protein, 1089 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 359 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 360 - protein, 976 aa, Homo sapiens [sequence omitted]

SEQ ID NO: 361 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 362 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 363 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 364 - protein, 416 aa, Homo sapiens
MEATGISLASQLKVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 365 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 366 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 367 - protein, 335 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 368 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 369 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 370 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 371 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 372 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 373 - protein, 440 aa, Homo sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 374 - protein, 259 aa, Homo sapiens
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMTTSPGTPASSHYLSCTIVGIIVLIVLLIVFV

SEQ ID NO: 375 - protein, 386 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCL

SEQ ID NO: 376 - protein, 263 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKEM

SEQ ID NO: 377 - protein, 401 aa, Homo sapiens
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 378 - protein, 181 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 379 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 380 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 381 - protein, 184 aa, Homo sapiens
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 382 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 383 - protein, 427 aa, Homo sapiens
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 384 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 385 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 386 - protein, 417 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 387 - protein, 430 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 388 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 389 - protein, 198 aa, Homo sapiens
MFGFFCSLVSSLSRWFLWRRLLLLLLLLLLNLPLQVKFAMLELHSFKCPAGEYWSKDVCCKNCSAGTFVKAPCEIPHTQGQCEKCHPGTFTEKDNYLDACILCSTCDKDQEMVADCSATSDRKCQCRTGLYYYDPKFPESCRPCTKCPQGIPVLQECNSTANTVCSSSVSNPRNRLFLLLSPLSVLIVSVVVFRIIRR

SEQ ID NO: 390 - protein, 176 aa, Homo sapiens
MVTFSHVSSLSHWFLLLLLLNLFLPVIFAMPESYSFNCPDGEYQSNDVCCKTCPSGTFVKAPCKIPHTQGQCEKCHPGTFTGKDNGLHDCELCSTCDKDQNMVADCSATSDRKCECQIGLYYYDPKFPESCRPCTKCPQGIPVLQECNSTANTVCSSSVSNPRNWLFLLMLIVFCI

SEQ ID NO: 391 - protein, 297 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADAPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 392 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 393 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 394 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 395 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 396 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 397 - protein, 352 aa, Homo sapiens [sequence omitted]

SEQ ID NO: 398 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 399 - protein, 315 aa, Homo sapiens
MYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 400 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 401 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 402 - protein, 362 aa, Homo sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 403 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 404 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 405 - protein, 415 aa, Homo sapiens
MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 406 - protein, 356 aa, Homo sapiens
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 407 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 408 - protein, 342 aa, Homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 409 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 410 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 411 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 412 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 413 - protein, 999 aa, Homo sapiens
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 414 - protein, 1489 aa, Homo sapiens
MRQVLWLCNVCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 415 - protein, 972 aa, Homo sapiens; identical to SEQ ID NO: 361

SEQ ID NO: 416 - protein, 1210 aa, Homo sapiens [sequence omitted]

SEQ ID NO: 417 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 418 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 419 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 420 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 421 - protein, 1037 aa, Homo sapiens
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 422 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 423 - protein, 1005 aa, Homo sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 424 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 425 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 426 - protein, 998 aa, Homo sapiens
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 427 - protein, 987 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 428 - protein, 1022 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKASAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 429 - protein, 1255 aa, Homo sapiens [sequence omitted]

SEQ ID NO: 430 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 431 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 432 - protein, 822 aa, Homo sapiens [sequence omitted]

SEQ ID NO: 433 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 434 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 435 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 436 - protein, 1503 aa, Homo sapiens
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 437 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 438 - protein, 993 aa, Homo sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 439 - protein, 1363 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 440 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 441 - protein, 1008 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQV

SEQ ID NO: 442 - protein, 398 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTRPTNHNKEQSELVKEDGLESLCEQCESSSGYGTGLVLMWKRNRRAMGASGQTRKQCDKRDNPPTDLFQTLTLNLCYSA

SEQ ID NO: 443 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 444 - protein, 1382 aa, Homo sapiens
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 445 - protein, 1297 aa, Homo sapiens
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 446 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 447 - protein, 976 aa, Homo sapiens [sequence omitted]

SEQ ID NO: 448 - protein, 864 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 449 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 450 - protein, 1400 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 451 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 452 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 453 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 454 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 455 - protein, 937 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 456 - protein, 943 aa, Homo sapiens
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 457 - protein, 855 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 458 - protein, 1089 aa, Homo sapiens; identical to SEQ ID NO: 358

SEQ ID NO: 459 - protein, 1106 aa, Homo sapiens; identical to SEQ ID NO: 359

SEQ ID NO: 460 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 461 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 462 - protein, 1114 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 463 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 464 - protein, 607 aa, Homo sapiens
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 465 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 466 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 467 - protein, 890 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 468 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 469 - protein, 1374 aa, Homo sapiens
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 470 - protein, 9 aa, Artificial sequence
  synthetic amino acid sequence
RMFPNAPYL

SEQ ID NO: 471 - protein, 10 aa, Artificial sequence
  synthetic amino acid sequence
KLVVVGAGGV

SEQ ID NO: 472 - protein, 10 aa, Artificial sequence
  synthetic amino acid sequence
KLVVVGAVGV

SEQ ID NO: 473 - protein, 10 aa, Artificial sequence
  synthetic amino acid sequence
KLVVVGACGV

SEQ ID NO: 474 - protein, 10 aa, Artificial sequence
  synthetic amino acid sequence
KLVVVGADGV

SEQ ID NO: 475 - protein, 9 aa, Artificial sequence
  synthetic amino acid sequence
VVGAVGVGK

SEQ ID NO: 476 - protein, 9 aa, Artificial sequence
  synthetic amino acid sequence
VVGACGVGK

SEQ ID NO: 477 - protein, 9 aa, Artificial sequence
  synthetic amino acid sequence
VVGAGGVGK

SEQ ID NO: 478 - protein, 9 aa, Artificial sequence
  synthetic amino acid sequence
KITDFGLAK

SEQ ID NO: 479 - protein, 9 aa, Artificial sequence
  synthetic amino acid sequence
KITDFGRAK

SEQ ID NO: 480 - protein, 9 aa, Artificial sequence
  synthetic amino acid sequence
VLQELNVTV

SEQ ID NO: 481 - protein, 9 aa, Artificial sequence
  synthetic amino acid sequence
EADPTGHSY

SEQ ID NO: 482 - protein, 9 aa, Artificial sequence
  synthetic amino acid sequence
LLGRNSFEV

SEQ ID NO: 483 - protein, 10 aa, Artificial sequence
  synthetic amino acid sequence
STTPPPGTRV

SEQ ID NO: 484 - protein, 10 aa, Artificial sequence
  synthetic amino acid sequence
ELAGIGILTV

SEQ ID NO: 485 - protein, 9 aa, Artificial sequence
  synthetic amino acid sequence
IMDQVPFSV

SEQ ID NO: 486 - protein, 9 aa, Artificial sequence
  synthetic amino acid sequence
NLVPMVATV

SEQ ID NO: 487 - protein, 9 aa, Artificial sequence
  synthetic amino acid sequence
AIIRILQQL

SEQ ID NO: 488 - protein, 9 aa, Artificial sequence
  synthetic amino acid sequence
VLHDDLLEA

SEQ ID NO: 489 - protein, 9 aa, Artificial sequence
  synthetic amino acid sequence
VLRDDLLEA

SEQ ID NO: 490 - protein, 9 aa, Artificial sequence
  synthetic amino acid sequence
SLLMWITQV

SEQ ID NO: 491 - protein, 10 aa, Artificial sequence
  synthetic amino acid sequence
LLDFVRFMGV

SEQ ID NO: 492 - protein, 9 aa, Artificial sequence
  synthetic amino acid sequence
FMNKFIYEI

SEQ ID NO: 493 - protein, 9 aa, Artificial sequence
  synthetic amino acid sequence
KIFGSLAFL

SEQ ID NO: 494 - protein, 9 aa, Artificial sequence
  synthetic amino acid sequence
GVLPALPQV

SEQ ID NO: 495 - protein, 9 aa, Artificial sequence
  synthetic amino acid sequence
FLLTRILTI

SEQ ID NO: 496 - protein, 9 aa, Artificial sequence
  synthetic amino acid sequence
HLSPIDCEV

SEQ ID NO: 497 - protein, 9 aa, Artificial sequence
  synthetic amino acid sequence
LTSMWSPAV

SEQ ID NO: 498 - protein, 9 aa, Artificial sequence
  synthetic amino acid sequence
HLDHPHPAV

SEQ ID NO: 499 - protein, 9 aa, Artificial sequence
  synthetic amino acid sequence
SLSVMSSNV

SEQ ID NO: 500 - protein, 9 aa, Artificial sequence
  synthetic amino acid sequence
MMAWSDNKI

SEQ ID NO: 501 - protein, 9 aa, Artificial sequence
  synthetic amino acid sequence
TQIGIEWNL

SEQ ID NO: 502 - protein, 9 aa, Artificial sequence
  synthetic amino acid sequence
CLFEMQDPA

SEQ ID NO: 503 - protein, 9 aa, Artificial sequence
  synthetic amino acid sequence
YLSHPSCNV

SEQ ID NO: 504 - protein, 9 aa, Artificial sequence
  synthetic amino acid sequence
GIEWNLSPV

SEQ ID NO: 505 - protein, 9 aa, Artificial sequence
  synthetic amino acid sequence
GLGCSPASI

SEQ ID NO: 506 - protein, 9 aa, Artificial sequence
  synthetic amino acid sequence
RQAFEFPQI

SEQ ID NO: 507 - protein, 9 aa, Artificial sequence
  synthetic amino acid sequence
RQAFEFPQI

SEQ ID NO: 508 - protein, 9 aa, Artificial sequence
  synthetic amino acid sequence
GMWTDTFEF

SEQ ID NO: 509 - protein, 9 aa, Artificial sequence
  synthetic amino acid sequence
YLNWQDTAV

SEQ ID NO: 510 - protein, 9 aa, Artificial sequence
  synthetic amino acid sequence
VLWGPITQI

SEQ ID NO: 511 - protein, 9 aa, Artificial sequence
  synthetic amino acid sequence
TLDHTGVVV

SEQ ID NO: 512 - protein, 9 aa, Artificial sequence
  synthetic amino acid sequence
TMGVWLHIA

SEQ ID NO: 513 - protein, 9 aa, Artificial sequence
  synthetic amino acid sequence
TMGVWLHIA

SEQ ID NO: 514 - protein, 9 aa, Artificial sequence
  synthetic amino acid sequence
KVWVQGHYL

SEQ ID NO: 515 - protein, 9 aa, Artificial sequence
  synthetic amino acid sequence
KINCNNFRL

SEQ ID NO: 516 - protein, 5 aa, Artificial sequence
  synthetic amino acid sequence
GSGGS

SEQ ID NO: 517 - protein, 4 aa, Artificial sequence
  synthetic amino acid sequence
GGGS

SEQ ID NO: 518 - protein, 4 aa, Artificial sequence
  synthetic amino acid sequence
GGSG

SEQ ID NO: 519 - protein, 5 aa, Artificial sequence
  synthetic amino acid sequence
GGSGG

SEQ ID NO: 520 - protein, 5 aa, Artificial sequence
  synthetic amino acid sequence
GSGSG

SEQ ID NO: 521 - protein, 5 aa, Artificial sequence
  synthetic amino acid sequence
GSGGG

SEQ ID NO: 522 - protein, 5 aa, Artificial sequence
  synthetic amino acid sequence
GGGSG

SEQ ID NO: 523 - protein, 5 aa, Artificial sequence
  synthetic amino acid sequence
GSSSG

SEQ ID NO: 524 - protein, 5 aa, Artificial sequence
  synthetic amino acid sequence
DKTHT

SEQ ID NO: 525 - protein, 4 aa, Artificial sequence
  synthetic amino acid sequence
CPPC

SEQ ID NO: 526 - protein, 15 aa, Artificial sequence
  synthetic amino acid sequence
CPEPKSCDTPPPCPR

SEQ ID NO: 527 - protein, 12 aa, Artificial sequence
  synthetic amino acid sequence
ELKTPLGDTTHT

SEQ ID NO: 528 - protein, 10 aa, Artificial sequence
  synthetic amino acid sequence
KSCDKTHTCP

SEQ ID NO: 529 - protein, 7 aa, Artificial sequence
  synthetic amino acid sequence
KCCVDCP

SEQ ID NO: 530 - protein, 7 aa, Artificial sequence
  synthetic amino acid sequence
KYGPPCP

SEQ ID NO: 531 - protein, 15 aa, Artificial sequence
  synthetic amino acid sequence
EPKSCDKTHTCPPCP

SEQ ID NO: 532 - protein, 12 aa, Artificial sequence
  synthetic amino acid sequence
ERKCCVECPPCP

SEQ ID NO: 533 - protein, 17 aa, Artificial sequence
  synthetic amino acid sequence
ELKTPLGDTTHTCPRCP

SEQ ID NO: 534 - protein, 12 aa, Artificial sequence
  synthetic amino acid sequence
SPNMVPHAHHAQ

SEQ ID NO: 535 - protein, 15 aa, Artificial sequence
  synthetic amino acid sequence
EPKSCDKTYTCPPCP

SEQ ID NO: 536 - protein, 45 aa, Artificial sequence
  synthetic amino acid sequence
TTTPAPRPPTPAPTIASQPLSLRPEACRPAAGGAVHTRGLDFACD

SEQ ID NO: 537 - protein, 24 aa, Artificial sequence
  synthetic amino acid sequence
IYIWAPLAGTCGVLLLSLVITLYC

SEQ ID NO: 538 - protein, 23 aa, Artificial sequence
  synthetic amino acid sequence
LGLLVAGVLVLLVSLGVAIHLCC

SEQ ID NO: 539 - protein, 25 aa, Artificial sequence
  synthetic amino acid sequence
ALIVLGGVAGLLLFIGLGIFFCVRC

SEQ ID NO: 540 - protein, 23 aa, Artificial sequence
  synthetic amino acid sequence
LCYLLDGILFIYGVILTALFLRV

SEQ ID NO: 541 - protein, 26 aa, Artificial sequence
  synthetic amino acid sequence
WVLVVVGGVLACYSLLVTVAFIIFWV

SEQ ID NO: 542 - protein, 26 aa, Artificial sequence
  synthetic amino acid sequence
VAAILGLGLVLGLLGPLAILLALYLL

SEQ ID NO: 543 - protein, 24 aa, Artificial sequence
  synthetic amino acid sequence
ALPAALAVISFLLGLGLGVACVLA

SEQ ID NO: 544 - protein, 42 aa, Artificial sequence; identical to SEQ ID NO: 218
  synthetic amino acid sequence

SEQ ID NO: 545 - protein, 44 aa, Artificial sequence
  synthetic amino acid sequence
FWVRSKRSRLLHSDYMNMTPRRPGPTRKHYQPYAPPRDFAAYRS

SEQ ID NO: 546 - protein, 35 aa, Artificial sequence; identical to SEQ ID NO: 214
  synthetic amino acid sequence

SEQ ID NO: 547 - protein, 37 aa, Artificial sequence
  synthetic amino acid sequence
RRDQRLPPDAHKPPGGGSFRTPIQEEQADAHSTLAKI

SEQ ID NO: 548 - protein, 114 aa, Artificial sequence; identical to SEQ ID NO: 231
  synthetic amino acid sequence

SEQ ID NO: 549 - protein, 49 aa, Artificial sequence
  synthetic amino acid sequence
HQRRKYRSNKGESPVEPAEPCRYSCPREEEGSTIPIQEDYRKPEPACSP

SEQ ID NO: 550 - protein, 187 aa, Artificial sequence; identical to SEQ ID NO: 234
  synthetic amino acid sequence

SEQ ID NO: 551 - protein, 54 aa, Artificial sequence; identical to SEQ ID NO: 222
  synthetic amino acid sequence

SEQ ID NO: 552 - protein, 60 aa, Artificial sequence
  synthetic amino acid sequence
CVKRRKPRGDVVKVIVSVQRKRQEAEGEATVIEALQAPPDVTTVAVEETIPSFTGRSPNH

SEQ ID NO: 553 - protein, 203 aa, Artificial sequence
  synthetic amino acid sequence
CSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQ

SEQ ID NO: 554 - protein, 78 aa, Artificial sequence
  synthetic amino acid sequence
MHGSLLQEKHRILHKLLQNGNSPAEVAKITAEATGKDTSSITSCGDGNVVKQEQLSPKKKENNALLRYLLDRDDPSDA

SEQ ID NO: 555 - protein, 301 aa, Artificial sequence
  synthetic amino acid sequence
STAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGP

SEQ ID NO: 556 - protein, 270 aa, Artificial sequence
  synthetic amino acid sequence
NYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 557 - protein, 702 aa, Artificial sequence
  synthetic amino acid sequence
KRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGP

SEQ ID NO: 558 - protein, 270 aa, Artificial sequence; identical to SEQ ID NO: 556
  synthetic amino acid sequence

SEQ ID NO: 559 - protein, 702 aa, Artificial sequence; identical to SEQ ID NO: 557
  synthetic amino acid sequence

SEQ ID NO: 560 - protein, 8 aa, Artificial sequence
  synthetic amino acid sequence
LLRYLLDK

SEQ ID NO: 561 - protein, 270 aa, Artificial sequence; identical to SEQ ID NO: 556
  synthetic amino acid sequence

SEQ ID NO: 562 - protein, 702 aa, Artificial sequence; identical to SEQ ID NO: 557
  synthetic amino acid sequence

SEQ ID NO: 563 - protein, 24 aa, Artificial sequence
  synthetic amino acid sequence
CDPASNLGLEDIIRKALMGSFDDK

SEQ ID NO: 564 - protein, 4 aa, Artificial sequence
  synthetic amino acid sequence
  MISC_FEATURE (2)..(3): the amino acid at this position may be any amino acid
  MISC_FEATURE (4)..(4): the amino acid at this position may be L or I
YXXX

SEQ ID NO: 565 - protein, 16 aa, Artificial sequence
  synthetic amino acid sequence
  MISC_FEATURE (2)..(3): the amino acid at this position may be any amino acid
  MISC_FEATURE (4)..(4): the amino acid at this position may be a L or I
  MISC_FEATURE (5)..(12): 6-8 amino acids may be present at these positions and, when present, the amino acids may be any amino acid
  MISC_FEATURE (14)..(15): the amino acid at this position may be any amino acid
  MISC_FEATURE (16)..(16): the amino acid at this position may be a L or I
YXXXXXXXXXXXYXXX

SEQ ID NO: 566 - protein, 113 aa, Artificial sequence
  synthetic amino acid sequence
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 567 - protein, 112 aa, Artificial sequence
  synthetic amino acid sequence
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 568 - protein, 102 aa, Artificial sequence
  synthetic amino acid sequence
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 569 - protein, 101 aa, Artificial sequence
  synthetic amino acid sequence
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 570 - protein, 21 aa, Artificial sequence
  synthetic amino acid sequence
ESPYQELQGQRSDVYSDLNTQ

SEQ ID NO: 571 - protein, 86 aa, Artificial sequence
  synthetic amino acid sequence
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 572 - protein, 21 aa, Artificial sequence
  synthetic amino acid sequence
DGVYTGLSTRNQETYETLKHE

SEQ ID NO: 573 - protein, 171 aa, Artificial sequence
  synthetic amino acid sequence
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 574 - protein, 127 aa, Artificial sequence
  synthetic amino acid sequence
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 575 - protein, 21 aa, Artificial sequence
  synthetic amino acid sequence
DQVYQPLRDRDDAQYSHLGGN

SEQ ID NO: 576 - protein, 207 aa, Artificial sequence
  synthetic amino acid sequence
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 577 - protein, 21 aa, Artificial sequence
  synthetic amino acid sequence
NPDYEPIRKGQRDLYSGLNQR

SEQ ID NO: 578 - protein, 182 aa, Artificial sequence
  synthetic amino acid sequence
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 579 - protein, 21 aa, Artificial sequence
  synthetic amino acid sequence
DQLYQPLKDREDDQYSHLQGN

SEQ ID NO: 580 - protein, 163 aa, Artificial sequence
  synthetic amino acid sequence
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 581 - protein, 164 aa, Artificial sequence
  synthetic amino acid sequence
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 582 - protein, 112 aa, Artificial sequence
  synthetic amino acid sequence
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 583 - protein, 21 aa, Artificial sequence
  synthetic amino acid sequence
NQLYNELNLGRREEYDVLDKR

SEQ ID NO: 584 - protein, 22 aa, Artificial sequence
  synthetic amino acid sequence
EGLYNELQKDKMAEAYSEIGMK

SEQ ID NO: 585 - protein, 21 aa, Artificial sequence
  synthetic amino acid sequence
DGLYQGLSTATKDTYDALHMQ

SEQ ID NO: 586 - protein, 226 aa, Artificial sequence
  synthetic amino acid sequence
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 587 - protein, 188 aa, Artificial sequence
  synthetic amino acid sequence
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 588 - protein, 21 aa, Artificial sequence
  synthetic amino acid sequence
ENLYEGLNLDDCSMYEDISRG

SEQ ID NO: 589 - protein, 20 aa, Artificial sequence
  synthetic amino acid sequence
RPRRSPAQDGKVYINMPGRG

SEQ ID NO: 590 - protein, 20 aa, Artificial sequence
  synthetic amino acid sequence
RPRRSPAQDGKVYINMPGRG

SEQ ID NO: 591 - protein, 68 aa, Artificial sequence
  synthetic amino acid sequence
FWVLVVVGGVLACYSLLVTVAFIIFWVRSKRSRLLHSDYMNMTPRRPGPTRKHYQPYAPPRDFAAYRS

SEQ ID NO: 592 - protein, 68 aa, Artificial sequence; identical to SEQ ID NO: 591
  synthetic amino acid sequence

SEQ ID NO: 593 - protein, 619 aa, Artificial sequence
  synthetic amino acid sequence
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 594 - protein, 9 aa, Artificial sequence
  synthetic amino acid sequence
YPYDVPDYA

SEQ ID NO: 595 - protein, 8 aa, Artificial sequence
  synthetic amino acid sequence
DYKDDDDK

SEQ ID NO: 596 - protein, 10 aa, Artificial sequence
  synthetic amino acid sequence
EQKLISEEDL

SEQ ID NO: 597 - protein, 5 aa, Artificial sequence
  synthetic amino acid sequence
HHHHH

SEQ ID NO: 598 - protein, 6 aa, Artificial sequence
  synthetic amino acid sequence
HHHHHH

SEQ ID NO: 599 - protein, 10 aa, Artificial sequence
  synthetic amino acid sequence
EQKLISEEDL

SEQ ID NO: 600 - protein, 8 aa, Artificial sequence
  synthetic amino acid sequence
DYKDDDDK

SEQ ID NO: 601 - protein, 8 aa, Artificial sequence
  synthetic amino acid sequence
WSHPQFEK

SEQ ID NO: 602 - protein, 9 aa, Artificial sequence
  synthetic amino acid sequence
YPYDVPDYA

SEQ ID NO: 603 - protein, 5 aa, Artificial sequence
  synthetic amino acid sequence
RYIRS

SEQ ID NO: 604 - protein, 4 aa, Artificial sequence
  synthetic amino acid sequence
FHHT

SEQ ID NO: 605 - protein, 17 aa, Artificial sequence
  synthetic amino acid sequence
WEAAAREACCRECCARA

SEQ ID NO: 606 - protein, 75 aa, Artificial sequence
  synthetic amino acid sequence
KRGRKKLLYIFKQPFMRPVQTTQEEDGCSCRFPEEEEGGCELSRGSGSGSTSPKKENNALLRYLLDRDDPSDAGS

SEQ ID NO: 607 - protein, 477 aa, Artificial sequence
  synthetic amino acid sequence
IYIWAPLAGTCGVLLLSLVITLYCSLKRGRKKLLYIFKQPFMRPVQTTQEEDGCSCRFPEEEEGGCELGSGSGSGSGSGSGSTSESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLYGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 608 - protein, 388 aa, Artificial sequence
  synthetic amino acid sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSPKKENNALLRYLLDRDDPSDAGS

SEQ ID NO: 609 - protein, 477 aa, Artificial sequence; identical to SEQ ID NO: 607
  synthetic amino acid sequence

SEQ ID NO: 610 - protein, 445 aa, Artificial sequence
  synthetic amino acid sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSMHGSLLQEKHRILHKLLQNGNSPAEVAKITAEATGKDTSSITSCGDGNVVKQEQLSPKKKENNALLRYLLDRDDPSDAGS

SEQ ID NO: 611 - protein, 477 aa, Artificial sequence; identical to SEQ ID NO: 607
  synthetic amino acid sequence

SEQ ID NO: 612 - protein, 445 aa, Artificial sequence
  synthetic amino acid sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSPKKENNALLRYLLDRDDPSDAGGGSGGGSPKKENNALLRYLLDRDDPSDAGGGSGGGSKKENNALLRYLLDRDDPSDAGS

SEQ ID NO: 613 - protein, 477 aa, Artificial sequence; identical to SEQ ID NO: 607
  synthetic amino acid sequence

SEQ ID NO: 614 - protein, 117 aa, Artificial sequence
  synthetic amino acid sequence
KRGRKKLLYIFKQPFMRPVQTTQEEDGCSCRFPEEEEGGCELSRGSGSGSTSDAFQLRQLILRGLQDDGGGSGGGSDAFQLRQLILRGLQDDGGGSGGGSDAFQLRQLILRGLQDDG

SEQ ID NO: 615 - protein, 381 aa, Artificial sequence
  synthetic amino acid sequence
IYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTS

SEQ ID NO: 616 - protein, 431 aa, Artificial sequence
  synthetic amino acid sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSDAFQLRQLILRGLQDDGGGSGGGSDAFQLRQLILRGLQDDGGGSGGGSDAFQLRQLILRGLQDDGS

SEQ ID NO: 617 - protein, 429 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTS

SEQ ID NO: 618 - protein, 42 aa, Artificial sequence; identical to SEQ ID NO: 218
  synthetic amino acid sequence

SEQ ID NO: 619 - protein, 44 aa, Artificial sequence; identical to SEQ ID NO: 545
  synthetic amino acid sequence

SEQ ID NO: 620 - protein, 35 aa, Artificial sequence; identical to SEQ ID NO: 214
  synthetic amino acid sequence

SEQ ID NO: 621 - protein, 37 aa, Artificial sequence; identical to SEQ ID NO: 547
  synthetic amino acid sequence

SEQ ID NO: 622 - protein, 114 aa, Artificial sequence; identical to SEQ ID NO: 231
  synthetic amino acid sequence

SEQ ID NO: 623 - protein, 49 aa, Artificial sequence; identical to SEQ ID NO: 549
  synthetic amino acid sequence

SEQ ID NO: 624 - protein, 187 aa, Artificial sequence; identical to SEQ ID NO: 234
  synthetic amino acid sequence

SEQ ID NO: 625 - protein, 54 aa, Artificial sequence; identical to SEQ ID NO: 222
  synthetic amino acid sequence

SEQ ID NO: 626 - protein, 60 aa, Artificial sequence; identical to SEQ ID NO: 552
  synthetic amino acid sequence

SEQ ID NO: 627 - protein, 113 aa, Artificial sequence; identical to SEQ ID NO: 566
  synthetic amino acid sequence

SEQ ID NO: 628 - protein, 112 aa, Artificial sequence; identical to SEQ ID NO: 567
  synthetic amino acid sequence

SEQ ID NO: 629 - protein, 102 aa, Artificial sequence; identical to SEQ ID NO: 568
  synthetic amino acid sequence

SEQ ID NO: 630 - protein, 101 aa, Artificial sequence; identical to SEQ ID NO: 569
  synthetic amino acid sequence

SEQ ID NO: 631 - protein, 21 aa, Artificial sequence
  synthetic amino acid sequence
ESPYQELQGQRSDVYSDLNTQ

SEQ ID NO: 632 - protein, 86 aa, Artificial sequence; identical to SEQ ID NO: 571
  synthetic amino acid sequence

SEQ ID NO: 633 - protein, 21 aa, Artificial sequence
  synthetic amino acid sequence
DGVYTGLSTRNQETYETLKHE

SEQ ID NO: 634 - protein, 171 aa, Artificial sequence; identical to SEQ ID NO: 573
  synthetic amino acid sequence

SEQ ID NO: 635 - protein, 127 aa, Artificial sequence; identical to SEQ ID NO: 574
  synthetic amino acid sequence

SEQ ID NO: 636 - protein, 21 aa, Artificial sequence
  synthetic amino acid sequence
DQVYQPLRDRDDAQYSHLGGN

SEQ ID NO: 637 - protein, 207 aa, Artificial sequence; identical to SEQ ID NO: 576
  synthetic amino acid sequence

SEQ ID NO: 638 - protein, 21 aa, Artificial sequence
  synthetic amino acid sequence
NPDYEPIRKGQRDLYSGLNQR

SEQ ID NO: 639 - protein, 182 aa, Artificial sequence; identical to SEQ ID NO: 578
  synthetic amino acid sequence

SEQ ID NO: 640 - protein, 21 aa, Artificial sequence
  synthetic amino acid sequence
DQLYQPLKDREDDQYSHLQGN

SEQ ID NO: 641 - protein, 163 aa, Artificial sequence; identical to SEQ ID NO: 580
  synthetic amino acid sequence

SEQ ID NO: 642 - protein, 164 aa, Artificial sequence; identical to SEQ ID NO: 581
  synthetic amino acid sequence

SEQ ID NO: 643 - protein, 112 aa, Artificial sequence; identical to SEQ ID NO: 582
  synthetic amino acid sequence

SEQ ID NO: 644 - protein, 21 aa, Artificial sequence
  synthetic amino acid sequence
NQLYNELNLGRREEYDVLDKR

SEQ ID NO: 645 - protein, 22 aa, Artificial sequence
  synthetic amino acid sequence
EGLYNELQKDKMAEAYSEIGMK

SEQ ID NO: 646 - protein, 21 aa, Artificial sequence
  synthetic amino acid sequence
DGLYQGLSTATKDTYDALHMQ

SEQ ID NO: 647 - protein, 226 aa, Artificial sequence; identical to SEQ ID NO: 586
  synthetic amino acid sequence

SEQ ID NO: 648 - protein, 188 aa, Artificial sequence; identical to SEQ ID NO: 587
  synthetic amino acid sequence

SEQ ID NO: 649 - protein, 21 aa, Artificial sequence
  synthetic amino acid sequence
ENLYEGLNLDDCSMYEDISRG

SEQ ID NO: 650 - protein, 20 aa, Artificial sequence
  synthetic amino acid sequence
RPRRSPAQDGKVYINMPGRG

SEQ ID NO: 651 - protein, 20 aa, Artificial sequence
  synthetic amino acid sequence
RPRRSPAQDGKVYINMPGRG

SEQ ID NO: 652 - protein, 68 aa, Artificial sequence; identical to SEQ ID NO: 591
  synthetic amino acid sequence

SEQ ID NO: 653 - protein, 68 aa, Artificial sequence; identical to SEQ ID NO: 591
  synthetic amino acid sequence

SEQ ID NO: 654 - protein, 619 aa, Artificial sequence; identical to SEQ ID NO: 593
  synthetic amino acid sequence

SEQ ID NO: 655 - protein, 24 aa, Artificial sequence
  synthetic amino acid sequence
IYIWAPLAGTCGVLLLSLVITLYC

SEQ ID NO: 656 - protein, 23 aa, Artificial sequence
  synthetic amino acid sequence
LGLLVAGVLVLLVSLGVAIHLCC

SEQ ID NO: 657 - protein, 25 aa, Artificial sequence
  synthetic amino acid sequence
ALIVLGGVAGLLLFIGLGIFFCVRC

SEQ ID NO: 658 - protein, 23 aa, Artificial sequence
  synthetic amino acid sequence
LCYLLDGILFIYGVILTALFLRV

SEQ ID NO: 659 - protein, 26 aa, Artificial sequence
  synthetic amino acid sequence
WVLVVVGGVLACYSLLVTVAFIIFWV

SEQ ID NO: 660 - protein, 26 aa, Artificial sequence
  synthetic amino acid sequence
VAAILGLGLVLGLLGPLAILLALYLL

SEQ ID NO: 661 - protein, 24 aa, Artificial sequence
  synthetic amino acid sequence
ALPAALAVISFLLGLGLGVACVLA

SEQ ID NO: 662 - protein, 203 aa, Artificial sequence; identical to SEQ ID NO: 553
  synthetic amino acid sequence

SEQ ID NO: 663 - protein, 301 aa, Artificial sequence; identical to SEQ ID NO: 555
  synthetic amino acid sequence

SEQ ID NO: 664 - protein, 270 aa, Artificial sequence; identical to SEQ ID NO: 556
  synthetic amino acid sequence

SEQ ID NO: 665 - protein, 702 aa, Artificial sequence; identical to SEQ ID NO: 557
  synthetic amino acid sequence

SEQ ID NO: 666 - protein, 270 aa, Artificial sequence; identical to SEQ ID NO: 556
  synthetic amino acid sequence

SEQ ID NO: 667 - protein, 702 aa, Artificial sequence; identical to SEQ ID NO: 557
  synthetic amino acid sequence

SEQ ID NO: 668 - protein, 8 aa, Artificial sequence
  synthetic amino acid sequence
LLRYLLDK

SEQ ID NO: 669 - protein, 24 aa, Artificial sequence
  synthetic amino acid sequence
CDPASNLGLEDIIRKALMGSFDDK

SEQ ID NO: 670 - protein, 9 aa, Artificial sequence
  synthetic amino acid sequence
SLLMWITQC

SEQ ID NO: 671 - protein, 9 aa, Artificial sequence
  synthetic amino acid sequence
SLLMWITQC

SEQ ID NO: 672 - protein, 9 aa, Artificial sequence
  synthetic amino acid sequence
SLLMWITQC

SEQ ID NO: 673 - protein, 9 aa, Artificial sequence
  synthetic amino acid sequence
SLLMWITQC

SEQ ID NO: 674 - protein, 9 aa, Artificial sequence
  synthetic amino acid sequence
SLLMWITQC

SEQ ID NO: 675 - protein, 275 aa, Artificial sequence
  synthetic amino acid sequence
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPTSGGSYIPTFGRGTSLIVHPPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 676 - protein, 275 aa, Artificial sequence
  synthetic amino acid sequence
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLYGGSYIPTFGRGTSLIVHPPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 677 - protein, 309 aa, Artificial sequence
  synthetic amino acid sequence
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYVGNTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 678 - protein, 309 aa, Artificial sequence
  synthetic amino acid sequence
MSIGLLCCAALSLLWAGPVNAGVTQTPKFQVLKTGQSMTLQCAQDMNHEYMSWYRQDPGMGLRLIHYSVAAGITDQGEVPNGYNVSRSTTEDFPLRLLSAAPSQTSVYFCASSYVGNTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 679 - protein, 208 aa, Artificial sequence
  synthetic amino acid sequence
MQEVTQIPAALSVPEGENLVLNCSFTDSAIYNLQWFRQDPGKGLTSLLLIQSSQREQTSGRLNASLDKSSGRSTLYIAASQPGDSATYLCAVRPTSGGSYIPTFGRGTSLIVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESS

SEQ ID NO: 680 - protein, 242 aa, Artificial sequence
  synthetic amino acid sequence
MGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYVGNTGELFFGEGSRLTVLEDLKNVFPPEVAVFEPSEAEISHTQKATLVCLATGFYPDHVELSWWVNGKEVHSGVSTDPQPLKEQPALNDSRYALSSRLRVSATFWQDPRNHFRCQVQFYGLSENDEWTQDRAKPVTQIVSAEAWGRAD

SEQ ID NO: 681 - protein, 98 aa, Artificial sequence; identical to SEQ ID NO: 228
  synthetic amino acid sequence

SEQ ID NO: 682 - protein, 39 aa, Artificial sequence; identical to SEQ ID NO: 216
  synthetic amino acid sequence

SEQ ID NO: 683 - protein, 258 aa, Artificial sequence
  synthetic amino acid sequence
YDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLV

SEQ ID NO: 684 - protein, 272 aa, Artificial sequence
  synthetic amino acid sequence
FWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQF

SEQ ID NO: 685 - protein, 275 aa, Artificial sequence
  synthetic amino acid sequence
FWEEFETLQQQECKLLYSRKEGQRQENKNKNRYKNILPFDHTRVVLHDGDPNEPVSDYINANIIMPEFETKCNNSKPKKSYIATQGCLQNTVNDFWRMVFQENSRVIVMTTKEVERGKSKCVKYWPDEYALKEYGVMRVRNVKESAAHDYTLRELKLSKVGQALLQGNTERTVWQYHFRTWPDHGVPSDPGGVLDFLEEVHHKQESIMDAGPVVVHCSAGIGRTGTFIVIDILIDIIREKGVDCDIDVPKTIQMVRSQRSGMVQTEAQYRFIYMA

SEQ ID NO: 686 - protein, 270 aa, Artificial sequence
  synthetic amino acid sequence
GPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 687 - protein, 255 aa, Artificial sequence
  synthetic amino acid sequence
LKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELH

SEQ ID NO: 688 - protein, 24 aa, Artificial sequence
  synthetic amino acid sequence
IYIWAPLAGTCGVLLLSLVITLYC

SEQ ID NO: 689 - protein, 23 aa, Artificial sequence
  synthetic amino acid sequence
LGLLVAGVLVLLVSLGVAIHLCC

SEQ ID NO: 690 - protein, 25 aa, Artificial sequence
  synthetic amino acid sequence
ALIVLGGVAGLLLFIGLGIFFCVRC

SEQ ID NO: 691 - protein, 23 aa, Artificial sequence
  synthetic amino acid sequence
LCYLLDGILFIYGVILTALFLRV

SEQ ID NO: 692 - protein, 26 aa, Artificial sequence
  synthetic amino acid sequence
WVLVVVGGVLACYSLLVTVAFIIFWV

SEQ ID NO: 693 - protein, 26 aa, Artificial sequence
  synthetic amino acid sequence
VAAILGLGLVLGLLGPLAILLALYLL

SEQ ID NO: 694 - protein, 24 aa, Artificial sequence
  synthetic amino acid sequence
ALPAALAVISFLLGLGLGVACVLA

SEQ ID NO: 695 - protein, 271 aa, Artificial sequence; identical to SEQ ID NO: 147
  synthetic amino acid sequence

SEQ ID NO: 696 - protein, 21 aa, Artificial sequence
  synthetic amino acid sequence
PKKENNALLRYLLDRDDPSDA

SEQ ID NO: 697 - protein, 79 aa, Artificial sequence
  synthetic amino acid sequence
PKKENNALLRYLLDRDDPSDAGGGSGGGSPKKENNALLRYLLDRDDPSDAGGGSGGGSPKKENNALLRYLLDRDDPSDA

SEQ ID NO: 698 - protein, 78 aa, Artificial sequence; identical to SEQ ID NO: 554
  synthetic amino acid sequence

SEQ ID NO: 699 - protein, 419 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSPKKENNALLRYLLDRDDPSDAGS

SEQ ID NO: 700 - protein, 476 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSMHGSLLQEKHRILHKLLQNGNSPAEVAKITAEATGKDTSSITSCGDGNVVKQEQLSPKKKENNALLRYLLDRDDPSDAGS

SEQ ID NO: 701 - protein, 476 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSPKKENNALLRYLLDRDDPSDAGGGSGGGSPKKENNALLRYLLDRDDPSDAGGGSGGGSKKENNALLRYLLDRDDPSDAGS

SEQ ID NO: 702 - protein, 775 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLYGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 703 - protein, 297 aa, Artificial sequence
  synthetic amino acid sequence
DRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTS

SEQ ID NO: 704 - protein, 297 aa, Artificial sequence
  synthetic amino acid sequence
DRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLFDLLLEMLDAHRLHAPTS

SEQ ID NO: 705 - protein, 297 aa, Artificial sequence
  synthetic amino acid sequence
DRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVVPLFDLLLEMLDAHRLHAPTS

SEQ ID NO: 706 - protein, 60 aa, Artificial sequence
  synthetic amino acid sequence
SGSGPGSREWFKDMLGGGSGGGSSGSGPGSREWFKDMLGGGSGGGSSGSGPGSREWFKDM

SEQ ID NO: 707 - protein, 64 aa, Artificial sequence
  synthetic amino acid sequence
DAFQLRQLILRGLQDDGGGSGGGSDAFQLRQLILRGLQDDGGGSGGGSDAFQLRQLILRGLQDD

SEQ ID NO: 708 - protein, 459 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSSGSGPGSREWFKDMLGGGSGGGSSGSGPGSREWFKDMLGGGSGGGSSGSGPGSREWFKDMLGS

SEQ ID NO: 709 - protein, 462 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSDAFQLRQLILRGLQDDGGGSGGGSDAFQLRQLILRGLQDDGGGSGGGSDAFQLRQLILRGLQDDGS

SEQ ID NO: 710 - protein, 801 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 711 - protein, 801 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLFDLLLEMLDAHRLHAPTSGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 712 - protein, 801 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVVPLFDLLLEMLDAHRLHAPTSGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 713 - protein, 781 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVAGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 714 - protein, 781 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVAGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 715 - protein, 465 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSPRQGSILYSMLTSAKQTGGGSGGGSPRQGSILYSMLTSAKQTGGGSGGGSPRQGSILYSMLTSAKQTGS

SEQ ID NO: 716 - protein, 471 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSLTERHKILHRLLQEGSPSDGGGSGGGSLTERHKILHRLLQEGSPSDGGGSGGGSLTERHKILHRLLQEGSPSDGS

SEQ ID NO: 717 - protein, 465 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSSKGQTKLLQLLTTKSDQGGGSGGGSSKGQTKLLQLLTTKSDQGGGSGGGSSKGQTKLLQLLTTKSDQGS

SEQ ID NO: 718 - protein, 465 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSAEEPSLLKKLLLAPANTGGGSGGGSAEEPSLLKKLLLAPANTGGGSGGGSAEEPSLLKKLLLAPANTGS

SEQ ID NO: 719 - protein, 465 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSAANNSLLLHLLKSQTIPGGGSGGGSAANNSLLLHLLKSQTIPGGGSGGGSAANNSLLLHLLKSQTIPGS

SEQ ID NO: 720 - protein, 820 aa, Artificial sequence
  synthetic amino acid sequence
MIHLGHILFLLLLPVAAAQTTPGERSSLPAFYPGTSGSCSGCGSLSLPIYIWAPLAGTCGVLLLSLVITLYCSLKRGRKKLLYIFKQPFMRPVQTTQEEDGCSCRFPEEEEGGCELGSGSGSGSGSGSGSTSVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQGSGSGSGSSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGSGSGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKCVTD

SEQ ID NO: 721 - protein, 456 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCSLKRGRKKLLYIFKQPFMRPVQTTQEEDGCSCRFPEEEEGGCELSRGSGSGSTSQAQQKSLLQQLLTEGGGSGGGSQAQQKSLLQQLLTEGGGSGGGSQAQQKSLLQQLLTEGS

SEQ ID NO: 722 - protein, 462 aa, Artificial sequence; identical to SEQ ID NO: 709
  synthetic amino acid sequence

SEQ ID NO: 723 - protein, 820 aa, Artificial sequence; identical to SEQ ID NO: 720
  synthetic amino acid sequence

What is claimed is:

1. One or more nucleic acids comprising:
    a) a first nucleotide sequence encoding a first polypeptide of a chimeric antigen receptor (CAR) heterodimer comprising an antigen binding domain and a first member of a dimerization pair; and
    b) a second nucleotide sequence encoding a second polypeptide of the CAR heterodimer comprising an intracellular signaling domain and a second member of the dimerization pair,
    wherein the first polypeptide of the CAR heterodimer, the second polypeptide of the CAR heterodimer or both comprise a co-stimulatory domain;
    wherein
        one member of the dimerization pair comprises a ligand-binding domain (LBD) of an estrogen receptor but not the DNA binding domain of the estrogen receptor and the other member of the dimerization pair comprises at least two copies of a co-regulator sequence, wherein the co-regulator sequence is in the range of 16 amino acids to 50 amino acids in length and comprises SEQ ID NO: 12; and
        receptor; and
    wherein the first polypeptide of the CAR heterodimer and the second polypeptide of the CAR heterodimer dimerize in the presence of estrogen or an analog thereof and, when present in the membrane of an immune cell, binding of the antigen binding domain of the dimerized CAR heterodimer to an antigen activates the immune cell.

2. The one or more nucleic acids according to claim 1, wherein the first polypeptide or the second polypeptide of the CAR heterodimer comprises three copies of the co-regulator of the nuclear hormone receptor.

3. The one or more nucleic acids according to claim 1, wherein the first polypeptide and the second polypeptide of the CAR heterodimer each comprise the same co-stimulatory domain.

4. The one or more nucleic acids according to claim 1, wherein the first polypeptide and the second polypeptide of the CAR heterodimer comprise different co-stimulatory domains.

5. The one or more nucleic acids according to claim 1, wherein the first polypeptide of the CAR heterodimer, the second polypeptide of the CAR heterodimer or both comprise two or more co-stimulatory domains.

6. The one or more nucleic acids according to claim 1, wherein the co-stimulatory domain is selected from the group consisting of: a 4-1BB (CD137) co-stimulatory domain, a CD28 co-stimulatory domain, a ICOS co-stimulatory domain, an OX-40 co-stimulatory domain, a BTLA co-stimulatory domain, a CD27 co-stimulatory domain, a CD30 co-stimulatory domain, a GITR co-stimulatory domain, and a HVEM co-stimulatory domain.

7. The one or more nucleic acids according to claim 1, wherein the first polypeptide of the CAR heterodimer comprises a transmembrane domain.

8. The one or more nucleic acids according to claim 1, wherein the second polypeptide of the CAR heterodimer comprises a transmembrane domain.

9. The one or more nucleic acids according to claim 1, wherein the antigen binding domain is an antibody.

10. The one or more nucleic acids according to claim 9, wherein the antibody specifically binds a cancer associated antigen.

11. The one or more nucleic acids according to claim 1, wherein the intracellular signaling domain comprises at least one immunoreceptor tyrosine-based activation motif (ITAM).

12. The one or more nucleic acids according to claim 11, wherein the intracellular signaling domain comprises an amino acid sequence having at least 85% sequence identity to one or more of SEQ ID NOs: 566-588.

13. The one or more nucleic acids according to claim 1, wherein the intracellular signaling domain comprises an amino acid sequence having at least 85% sequence identity to one or more of SEQ ID NOs: 589-593.

14. The one or more nucleic acids according to claim 1, wherein the one or more nucleic acids comprises a first nucleic acid comprising the first nucleotide sequence and a second nucleic acid comprising the second nucleotide sequence.

15. The one or more nucleic acids according to claim 14, wherein the first nucleic acid is present in a first recombinant expression vector, and wherein the second nucleic acid is present in a second expression vector.

16. The one or more nucleic acids according to claim 1, wherein the one or more nucleic acids is a single nucleic acid comprising the first nucleotide sequence and the second nucleotide sequence.

17. The one or more nucleic acids according to claim 16, wherein the single nucleic acid is present in a recombinant expression vector.

18. The one or more nucleic acids according to claim 17, wherein the recombinant expression vector comprises an immune cell specific promoter operably linked to the first nucleotide sequence and the second nucleotide sequence.

* * * * *